United States Patent 11,464,842 (COMPOSITIONS AND METHOD FOR OPTIMIZED PEPTIDE VACCINES USING RESIDUE OPTIMIZATION) - sequence listing, part 41

SEQ ID NO: 338124 - protein, 23 aa, Artificial Sequence
  Description of Artificial Sequence: Synthetic peptide
  Seed: SYVPLAHSSSAFTITDQVPFSVS (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPFSVS

SEQ ID NO: 338125 - protein, 23 aa, Artificial Sequence
  Description of Artificial Sequence: Synthetic peptide
  Seed: SYVPLAHSSSAFTITDQVPFSVS (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPFSVS

SEQ ID NO: 338126 - protein, 23 aa, Artificial Sequence
  Description of Artificial Sequence: Synthetic peptide
  Seed: SYVPLAHSSSAFTITDQVPFSVS (PMEL_HUMAN)
  Core: FTITDQVPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAXTIXDXVPXSVS

SEQ ID NO: 338127 - protein, 24 aa, Artificial Sequence
  Description of Artificial Sequence: Synthetic peptide
  Seed: SYVPLAHSSSAFTITDQVPFSVSV (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPFSVSV

SEQ ID NO: 338128 - protein, 24 aa, Artificial Sequence
  Description of Artificial Sequence: Synthetic peptide
  Seed: SYVPLAHSSSAFTITDQVPFSVSV (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPFSVSV

SEQ ID NO: 338129 - protein, 24 aa, Artificial Sequence
  Description of Artificial Sequence: Synthetic peptide
  Seed: SYVPLAHSSSAFTITDQVPFSVSV (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPFSVSV

SEQ ID NO: 338130 - protein, 24 aa, Artificial Sequence
  Description of Artificial Sequence: Synthetic peptide
  Seed: SYVPLAHSSSAFTITDQVPFSVSV (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPFSVSV

SEQ ID NO: 338131 - protein, 24 aa, Artificial Sequence
  Description of Artificial Sequence: Synthetic peptide
  Seed: SYVPLAHSSSAFTITDQVPFSVSV (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPFSVSV

SEQ ID NO: 338132 - protein, 24 aa, Artificial Sequence
  Description of Artificial Sequence: Synthetic peptide
  Seed: SYVPLAHSSSAFTITDQVPFSVSV (PMEL_HUMAN)
  Core: FTITDQVPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAXTIXDXVPXSVSV

SEQ ID NO: 338133 - protein, 25 aa, Artificial Sequence
  Description of Artificial Sequence: Synthetic peptide
  Seed: SYVPLAHSSSAFTITDQVPFSVSVS (PMEL_HUMAN)
  Core: LAHSSSAFT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
SYVPXAHXSXAFXITDQVPFSVSVS

SEQ ID NO: 338134 - protein, 25 aa, Artificial Sequence
  Description of Artificial Sequence: Synthetic peptide
  Seed: SYVPLAHSSSAFTITDQVPFSVSVS (PMEL_HUMAN)
  Core: AHSSSAFTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLXHSXSXFTXTDQVPFSVSVS

SEQ ID NO: 338135 - protein, 25 aa, Artificial Sequence
  Description of Artificial Sequence: Synthetic peptide
  Seed: SYVPLAHSSSAFTITDQVPFSVSVS (PMEL_HUMAN)
  Core: HSSSAFTIT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAXSSXAXTIXDQVPFSVSVS

SEQ ID NO: 338136 - protein, 25 aa, Artificial Sequence
  Description of Artificial Sequence: Synthetic peptide
  Seed: SYVPLAHSSSAFTITDQVPFSVSVS (PMEL_HUMAN)
  Core: SSAFTITDQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSXSAXTXTDXVPFSVSVS

SEQ ID NO: 338137 - protein, 25 aa, Artificial Sequence
  Description of Artificial Sequence: Synthetic peptide
  Seed: SYVPLAHSSSAFTITDQVPFSVSVS (PMEL_HUMAN)
  Core: SAFTITDQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSXAFXIXDQXPFSVSVS

SEQ ID NO: 338138 - protein, 25 aa, Artificial Sequence
  Description of Artificial Sequence: Synthetic peptide
  Seed: SYVPLAHSSSAFTITDQVPFSVSVS (PMEL_HUMAN)
  Core: FTITDQVPF
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAXTIXDXVPXSVSVS

SEQ ID NO: 338139 - protein, 25 aa, Artificial Sequence
  Description of Artificial Sequence: Synthetic peptide
  Seed: SYVPLAHSSSAFTITDQVPFSVSVS (PMEL_HUMAN)
  Core: ITDQVPFSV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
SYVPLAHSSSAFTXTDXVXFSXSVS

SEQ ID NO: 338140 - protein, 15 aa, Artificial Sequence
  Description of Artificial Sequence: Synthetic peptide
  Seed: TAAQVTTTEWVETTA (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTA

SEQ ID NO: 338141 - protein, 16 aa, Artificial Sequence
  Description of Artificial Sequence: Synthetic peptide
  Seed: TAAQVTTTEWVETTAR (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTAR

SEQ ID NO: 338142 - protein, 17 aa, Artificial Sequence
  Description of Artificial Sequence: Synthetic peptide
  Seed: TAAQVTTTEWVETTARE (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARE

SEQ ID NO: 338143 - protein, 18 aa, Artificial Sequence
  Description of Artificial Sequence: Synthetic peptide
  Seed: TAAQVTTTEWVETTAREL (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREX

SEQ ID NO: 338144 - protein, 19 aa, Artificial Sequence
  Description of Artificial Sequence: Synthetic peptide
  Seed: TAAQVTTTEWVETTARELP (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELP

SEQ ID NO: 338145 - protein, 19 aa, Artificial Sequence
  Description of Artificial Sequence: Synthetic peptide
  Seed: TAAQVTTTEWVETTARELP (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXP

SEQ ID NO: 338146 - protein, 20 aa, Artificial Sequence
  Description of Artificial Sequence: Synthetic peptide
  Seed: TAAQVTTTEWVETTARELPI (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPI

SEQ ID NO: 338147 - protein, 20 aa, Artificial Sequence
  Description of Artificial Sequence: Synthetic peptide
  Seed: TAAQVTTTEWVETTARELPI (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPI

SEQ ID NO: 338148 - protein, 21 aa, Artificial Sequence
  Description of Artificial Sequence: Synthetic peptide
  Seed: TAAQVTTTEWVETTARELPIP (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPIP

SEQ ID NO: 338149 - protein, 21 aa, Artificial Sequence
  Description of Artificial Sequence: Synthetic peptide
  Seed: TAAQVTTTEWVETTARELPIP (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPIP

SEQ ID NO: 338150 - protein, 22 aa, Artificial Sequence
  Description of Artificial Sequence: Synthetic peptide
  Seed: TAAQVTTTEWVETTARELPIPE (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPIPE

SEQ ID NO: 338151 - protein, 22 aa, Artificial Sequence
  Description of Artificial Sequence: Synthetic peptide
  Seed: TAAQVTTTEWVETTARELPIPE (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPIPE

SEQ ID NO: 338152 - protein, 23 aa, Artificial Sequence
  Description of Artificial Sequence: Synthetic peptide
  Seed: TAAQVTTTEWVETTARELPIPEP (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPIPEP

SEQ ID NO: 338153 - protein, 23 aa, Artificial Sequence
  Description of Artificial Sequence: Synthetic peptide
  Seed: TAAQVTTTEWVETTARELPIPEP (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPIPEP

SEQ ID NO: 338154 - protein, 24 aa, Artificial Sequence
  Description of Artificial Sequence: Synthetic peptide
  Seed: TAAQVTTTEWVETTARELPIPEPE (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPIPEPE

SEQ ID NO: 338155 - protein, 24 aa, Artificial Sequence
  Description of Artificial Sequence: Synthetic peptide
  Seed: TAAQVTTTEWVETTARELPIPEPE (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPIPEPE

SEQ ID NO: 338156 - protein, 25 aa, Artificial Sequence
  Description of Artificial Sequence: Synthetic peptide
  Seed: TAAQVTTTEWVETTARELPIPEPEG (PMEL_HUMAN)
  Core: VTTTEWVET
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAAQXTTXEXVEXTARELPIPEPEG

SEQ ID NO: 338157 - protein, 25 aa, Artificial Sequence
  Description of Artificial Sequence: Synthetic peptide
  Seed: TAAQVTTTEWVETTARELPIPEPEG (PMEL_HUMAN)
  Core: WVETTAREL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAAQVTTTEXVEXTXREXPIPEPEG

SEQ ID NO: 338158 - protein, 15 aa, Artificial Sequence
  Description of Artificial Sequence: Synthetic peptide
  Seed: TAEAPNTTAGQVPTT (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTX

SEQ ID NO: 338159 - protein, 16 aa, Artificial Sequence
  Description of Artificial Sequence: Synthetic peptide
  Seed: TAEAPNTTAGQVPTTE (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXE

SEQ ID NO: 338160 - protein, 17 aa, Artificial Sequence
  Description of Artificial Sequence: Synthetic peptide
  Seed: TAEAPNTTAGQVPTTEV (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEV

SEQ ID NO: 338161 - protein, 18 aa, Artificial Sequence
  Description of Artificial Sequence: Synthetic peptide
  Seed: TAEAPNTTAGQVPTTEVV (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVV

SEQ ID NO: 338162 - protein, 19 aa, Artificial Sequence
  Description of Artificial Sequence: Synthetic peptide
  Seed: TAEAPNTTAGQVPTTEVVG (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVG

SEQ ID NO: 338163 - protein, 20 aa, Artificial Sequence
  Description of Artificial Sequence: Synthetic peptide
  Seed: TAEAPNTTAGQVPTTEVVGT (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGT

SEQ ID NO: 338164 - protein, 21 aa, Artificial Sequence
  Description of Artificial Sequence: Synthetic peptide
  Seed: TAEAPNTTAGQVPTTEVVGTT (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGTT

SEQ ID NO: 338165 - protein, 22 aa, Artificial Sequence
  Description of Artificial Sequence: Synthetic peptide
  Seed: TAEAPNTTAGQVPTTEVVGTTP (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGTTP

SEQ ID NO: 338166 - protein, 23 aa, Artificial Sequence
  Description of Artificial Sequence: Synthetic peptide
  Seed: TAEAPNTTAGQVPTTEVVGTTPG (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGTTPG

SEQ ID NO: 338167 - protein, 24 aa, Artificial Sequence
  Description of Artificial Sequence: Synthetic peptide
  Seed: TAEAPNTTAGQVPTTEVVGTTPGQ (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGTTPGQ

SEQ ID NO: 338168 - protein, 25 aa, Artificial Sequence
  Description of Artificial Sequence: Synthetic peptide
  Seed: TAEAPNTTAGQVPTTEVVGTTPGQA (PMEL_HUMAN)
  Core: TTAGQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEAPNXTAXQXPTXEVVGTTPGQA

SEQ ID NO: 338169 - protein, 14 aa, Artificial Sequence
  Description of Artificial Sequence: Synthetic peptide
  Seed: TAEPSGTTSVQVPT (PMEL_HUMAN)
  Core: PSGTTSVQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXSGXTXVQXPT

SEQ ID NO: 338170 - protein, 15 aa, Artificial Sequence
  Description of Artificial Sequence: Synthetic peptide
  Seed: TAEPSGTTSVQVPTT (PMEL_HUMAN)
  Core: PSGTTSVQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXSGXTXVQXPTT

SEQ ID NO: 338171 - protein, 16 aa, Artificial Sequence
  Description of Artificial Sequence: Synthetic peptide
  Seed: TAEPSGTTSVQVPTTE (PMEL_HUMAN)
  Core: PSGTTSVQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXSGXTXVQXPTTE

SEQ ID NO: 338172 - protein, 17 aa, Artificial Sequence
  Description of Artificial Sequence: Synthetic peptide
  Seed: TAEPSGTTSVQVPTTEV (PMEL_HUMAN)
  Core: PSGTTSVQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXSGXTXVQXPTTEV

SEQ ID NO: 338173 - protein, 19 aa, Artificial Sequence
  Description of Artificial Sequence: Synthetic peptide
  Seed: TAEPSGTTSVQVPTTEVIS (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVIS

SEQ ID NO: 338174 - protein, 20 aa, Artificial Sequence
  Description of Artificial Sequence: Synthetic peptide
  Seed: TAEPSGTTSVQVPTTEVIST (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVIST

SEQ ID NO: 338175 - protein, 21 aa, Artificial Sequence
  Description of Artificial Sequence: Synthetic peptide
  Seed: TAEPSGTTSVQVPTTEVISTA (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVISTA

SEQ ID NO: 338176 - protein, 22 aa, Artificial Sequence
  Description of Artificial Sequence: Synthetic peptide
  Seed: TAEPSGTTSVQVPTTEVISTAP (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVISTAP

SEQ ID NO: 338177 - protein, 23 aa, Artificial Sequence
  Description of Artificial Sequence: Synthetic peptide
  Seed: TAEPSGTTSVQVPTTEVISTAPV (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVISTAPV

SEQ ID NO: 338178 - protein, 24 aa, Artificial Sequence
  Description of Artificial Sequence: Synthetic peptide
  Seed: TAEPSGTTSVQVPTTEVISTAPVQ (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVISTAPVQ

SEQ ID NO: 338179 - protein, 24 aa, Artificial Sequence
  Description of Artificial Sequence: Synthetic peptide
  Seed: TAEPSGTTSVQVPTTEVISTAPVQ (PMEL_HUMAN)
  Core: PTTEVISTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGTTSVQVXTTXVXSTXPVQ

SEQ ID NO: 338180 - protein, 25 aa, Artificial Sequence
  Description of Artificial Sequence: Synthetic peptide
  Seed: TAEPSGTTSVQVPTTEVISTAPVQM (PMEL_HUMAN)
  Core: PSGTTSVQV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXSGXTXVQXPTTEVISTAPVQM

SEQ ID NO: 338181 - protein, 25 aa, Artificial Sequence
  Description of Artificial Sequence: Synthetic peptide
  Seed: TAEPSGTTSVQVPTTEVISTAPVQM (PMEL_HUMAN)
  Core: TTSVQVPTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGXTSXQXPTXEVISTAPVQM

SEQ ID NO: 338182 - protein, 25 aa, Artificial Sequence
  Description of Artificial Sequence: Synthetic peptide
  Seed: TAEPSGTTSVQVPTTEVISTAPVQM (PMEL_HUMAN)
  Core: PTTEVISTA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TAEPSGTTSVQVXTTXVXSTXPVQM

SEQ ID NO: 338183 - protein, 15 aa, Artificial Sequence
  Description of Artificial Sequence: Synthetic peptide
  Seed: TAESTGMTPEKVPVS (PMEL_HUMAN)
  Core: STGMTPEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXTGXTXEKXPVS

SEQ ID NO: 338184 - protein, 20 aa, Artificial Sequence
  Description of Artificial Sequence: Synthetic peptide
  Seed: TAESTGMTPEKVPVSEVMGT (PMEL_HUMAN)
  Core: STGMTPEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXTGXTXEKXPVSEVMGT

SEQ ID NO: 338185 - protein, 20 aa, Artificial Sequence
  Description of Artificial Sequence: Synthetic peptide
  Seed: TAESTGMTPEKVPVSEVMGT (PMEL_HUMAN)
  Core: MTPEKVPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAESTGXTPXKXPVXEVMGT

SEQ ID NO: 338186 - protein, 25 aa, Artificial Sequence
  Description of Artificial Sequence: Synthetic peptide
  Seed: TAESTGMTPEKVPVSEVMGTTLAEM (PMEL_HUMAN)
  Core: STGMTPEKV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAEXTGXTXEKXPVSEVMGTTLAEM

SEQ ID NO: 338187 - protein, 25 aa, Artificial Sequence
  Description of Artificial Sequence: Synthetic peptide
  Seed: TAESTGMTPEKVPVSEVMGTTLAEM (PMEL_HUMAN)
  Core: MTPEKVPVS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TAESTGXTPXKXPVXEVMGTTLAEM

SEQ ID NO: 338188 - protein, 25 aa, Artificial Sequence
  Description of Artificial Sequence: Synthetic peptide
  Seed: TAESTGMTPEKVPVSEVMGTTLAEM (PMEL_HUMAN)
  Core: VMGTTLAEM
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
TAESTGMTPEKVPVSEXMGXTXAEX

SEQ ID NO: 338189 - protein, 19 aa, Artificial Sequence
  Description of Artificial Sequence: Synthetic peptide
  Seed: TAGQVPTTEVVGTTPGQAP (PMEL_HUMAN)
  Core: PTTEVVGTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVXTTXVXGTXPGQAP

SEQ ID NO: 338190 - protein, 19 aa, Artificial Sequence
  Description of Artificial Sequence: Synthetic peptide
  Seed: TAGQVPTTEVVGTTPGQAP (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXP

SEQ ID NO: 338191 - protein, 20 aa, Artificial Sequence
  Description of Artificial Sequence: Synthetic peptide
  Seed: TAGQVPTTEVVGTTPGQAPT (PMEL_HUMAN)
  Core: PTTEVVGTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVXTTXVXGTXPGQAPT

SEQ ID NO: 338192 - protein, 20 aa, Artificial Sequence
  Description of Artificial Sequence: Synthetic peptide
  Seed: TAGQVPTTEVVGTTPGQAPT (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPT

SEQ ID NO: 338193 - protein, 21 aa, Artificial Sequence
  Description of Artificial Sequence: Synthetic peptide
  Seed: TAGQVPTTEVVGTTPGQAPTA (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPTA

SEQ ID NO: 338194 - protein, 22 aa, Artificial Sequence
  Description of Artificial Sequence: Synthetic peptide
  Seed: TAGQVPTTEVVGTTPGQAPTAE (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPTAE

SEQ ID NO: 338195 - protein, 23 aa, Artificial Sequence
  Description of Artificial Sequence: Synthetic peptide
  Seed: TAGQVPTTEVVGTTPGQAPTAEP (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPTAEP

SEQ ID NO: 338196 - protein, 24 aa, Artificial Sequence
  Description of Artificial Sequence: Synthetic peptide
  Seed: TAGQVPTTEVVGTTPGQAPTAEPS (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPTAEPS

SEQ ID NO: 338197 - protein, 25 aa, Artificial Sequence
  Description of Artificial Sequence: Synthetic peptide
  Seed: TAGQVPTTEVVGTTPGQAPTAEPSG (PMEL_HUMAN)
  Core: VVGTTPGQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TAGQVPTTEXVGXTXGQXPTAEPSG

SEQ ID NO: 338198 - protein, 15 aa, Artificial Sequence
  Description of Artificial Sequence: Synthetic peptide
  Seed: TAPVQMPTAESTGMT (PMEL_HUMAN)
  Core: VQMPTAEST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAPXQMXTXESXGMT

SEQ ID NO: 338199 - protein, 16 aa, Artificial Sequence
  Description of Artificial Sequence: Synthetic peptide
  Seed: TAPVQMPTAESTGMTP (PMEL_HUMAN)
  Core: VQMPTAEST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAPXQMXTXESXGMTP

SEQ ID NO: 338200 - protein, 20 aa, Artificial Sequence
  Description of Artificial Sequence: Synthetic peptide
  Seed: TAPVQMPTAESTGMTPEKVP (PMEL_HUMAN)
  Core: VQMPTAEST
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAPXQMXTXESXGMTPEKVP

SEQ ID NO: 338201 - protein, 13 aa, Artificial Sequence
  Description of Artificial Sequence: Synthetic peptide
  Seed: TAQVVLQAAIPLT (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXT

SEQ ID NO: 338202 - protein, 14 aa, Artificial Sequence
  Description of Artificial Sequence: Synthetic peptide
  Seed: TAQVVLQAAIPLTS (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTS

SEQ ID NO: 338203 - protein, 14 aa, Artificial Sequence
  Description of Artificial Sequence: Synthetic peptide
  Seed: TAQVVLQAAIPLTS (PMEL_HUMAN)
  Core: VLQAAIPLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAQVXLQXAXPLXS

SEQ ID NO: 338204 - protein, 14 aa, Artificial Sequence
  Description of Artificial Sequence: Synthetic peptide
  Seed: TAQVVLQAAIPLTS (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTX

SEQ ID NO: 338205 - protein, 15 aa, Artificial Sequence
  Description of Artificial Sequence: Synthetic peptide
  Seed: TAQVVLQAAIPLTSC (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSC

SEQ ID NO: 338206 - protein, 15 aa, Artificial Sequence
  Description of Artificial Sequence: Synthetic peptide
  Seed: TAQVVLQAAIPLTSC (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXC

SEQ ID NO: 338207 - protein, 16 aa, Artificial Sequence
  Description of Artificial Sequence: Synthetic peptide
  Seed: TAQVVLQAAIPLTSCG (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCG

SEQ ID NO: 338208 - protein, 16 aa, Artificial Sequence
  Description of Artificial Sequence: Synthetic peptide
  Seed: TAQVVLQAAIPLTSCG (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCG

SEQ ID NO: 338209 - protein, 17 aa, Artificial Sequence
  Description of Artificial Sequence: Synthetic peptide
  Seed: TAQVVLQAAIPLTSCGS (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGS

SEQ ID NO: 338210 - protein, 17 aa, Artificial Sequence
  Description of Artificial Sequence: Synthetic peptide
  Seed: TAQVVLQAAIPLTSCGS (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGS

SEQ ID NO: 338211 - protein, 18 aa, Artificial Sequence
  Description of Artificial Sequence: Synthetic peptide
  Seed: TAQVVLQAAIPLTSCGSS (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSS

SEQ ID NO: 338212 - protein, 18 aa, Artificial Sequence
  Description of Artificial Sequence: Synthetic peptide
  Seed: TAQVVLQAAIPLTSCGSS (PMEL_HUMAN)
  Core: VLQAAIPLT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TAQVXLQXAXPLXSCGSS

SEQ ID NO: 338213 - protein, 18 aa, Artificial Sequence
  Description of Artificial Sequence: Synthetic peptide
  Seed: TAQVVLQAAIPLTSCGSS (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSS

SEQ ID NO: 338214 - protein, 19 aa, Artificial Sequence
  Description of Artificial Sequence: Synthetic peptide
  Seed: TAQVVLQAAIPLTSCGSSP (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSP

SEQ ID NO: 338215 - protein, 19 aa, Artificial Sequence
  Description of Artificial Sequence: Synthetic peptide
  Seed: TAQVVLQAAIPLTSCGSSP (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSP

SEQ ID NO: 338216 - protein, 20 aa, Artificial Sequence
  Description of Artificial Sequence: Synthetic peptide
  Seed: TAQVVLQAAIPLTSCGSSPV (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPV

SEQ ID NO: 338217 - protein, 20 aa, Artificial Sequence
  Description of Artificial Sequence: Synthetic peptide
  Seed: TAQVVLQAAIPLTSCGSSPV (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPV

SEQ ID NO: 338218 - protein, 21 aa, Artificial Sequence
  Description of Artificial Sequence: Synthetic peptide
  Seed: TAQVVLQAAIPLTSCGSSPVP (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPVP

SEQ ID NO: 338219 - protein, 21 aa, Artificial Sequence
  Description of Artificial Sequence: Synthetic peptide
  Seed: TAQVVLQAAIPLTSCGSSPVP (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPVP

SEQ ID NO: 338220 - protein, 22 aa, Artificial Sequence
  Description of Artificial Sequence: Synthetic peptide
  Seed: TAQVVLQAAIPLTSCGSSPVPG (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPVPG

SEQ ID NO: 338221 - protein, 22 aa, Artificial Sequence
  Description of Artificial Sequence: Synthetic peptide
  Seed: TAQVVLQAAIPLTSCGSSPVPG (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPVPG

SEQ ID NO: 338222 - protein, 22 aa, Artificial Sequence
  Description of Artificial Sequence: Synthetic peptide
  Seed: TAQVVLQAAIPLTSCGSSPVPG (PMEL_HUMAN)
  Core: LTSCGSSPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVLQAAIPXTSXGXSPXPG

SEQ ID NO: 338223 - protein, 23 aa, Artificial Sequence
  Description of Artificial Sequence: Synthetic peptide
  Seed: TAQVVLQAAIPLTSCGSSPVPGT (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPVPGT

SEQ ID NO: 338224 - protein, 23 aa, Artificial Sequence
  Description of Artificial Sequence: Synthetic peptide
  Seed: TAQVVLQAAIPLTSCGSSPVPGT (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPVPGT

SEQ ID NO: 338225 - protein, 23 aa, Artificial Sequence
  Description of Artificial Sequence: Synthetic peptide
  Seed: TAQVVLQAAIPLTSCGSSPVPGT (PMEL_HUMAN)
  Core: LTSCGSSPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVLQAAIPXTSXGXSPXPGT

SEQ ID NO: 338226 - protein, 24 aa, Artificial Sequence
  Description of Artificial Sequence: Synthetic peptide
  Seed: TAQVVLQAAIPLTSCGSSPVPGTT (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPVPGTT

SEQ ID NO: 338227 - protein, 24 aa, Artificial Sequence
  Description of Artificial Sequence: Synthetic peptide
  Seed: TAQVVLQAAIPLTSCGSSPVPGTT (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPVPGTT

SEQ ID NO: 338228 - protein, 24 aa, Artificial Sequence
  Description of Artificial Sequence: Synthetic peptide
  Seed: TAQVVLQAAIPLTSCGSSPVPGTT (PMEL_HUMAN)
  Core: LTSCGSSPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVLQAAIPXTSXGXSPXPGTT

SEQ ID NO: 338229 - protein, 25 aa, Artificial Sequence
  Description of Artificial Sequence: Synthetic peptide
  Seed: TAQVVLQAAIPLTSCGSSPVPGTTD (PMEL_HUMAN)
  Core: VVLQAAIPL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TAQXVLXAXIPXTSCGSSPVPGTTD

SEQ ID NO: 338230 - protein, 25 aa, Artificial Sequence
  Description of Artificial Sequence: Synthetic peptide
  Seed: TAQVVLQAAIPLTSCGSSPVPGTTD (PMEL_HUMAN)
  Core: LQAAIPLTS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVXQAXIXLTXCGSSPVPGTTD

SEQ ID NO: 338231 - protein, 25 aa, Artificial Sequence
  Description of Artificial Sequence: Synthetic peptide
  Seed: TAQVVLQAAIPLTSCGSSPVPGTTD (PMEL_HUMAN)
  Core: LTSCGSSPV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TAQVVLQAAIPXTSXGXSPXPGTTD

SEQ ID NO: 338232 - protein, 22 aa, Artificial Sequence
  Description of Artificial Sequence: Synthetic peptide
  Seed: TARELPIPEPEGPDASSIMSTE (PMEL_HUMAN)
  Core: PDASSIMST
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TARELPIPEPEGXDAXSXMSXE

SEQ ID NO: 338233 - protein, 23 aa, Artificial Sequence
  Description of Artificial Sequence: Synthetic peptide
  Seed: TARELPIPEPEGPDASSIMSTES (PMEL_HUMAN)
  Core: PDASSIMST
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TARELPIPEPEGXDAXSXMSXES

SEQ ID NO: 338234 - protein, 24 aa, Artificial Sequence
  Description of Artificial Sequence: Synthetic peptide
  Seed: TARELPIPEPEGPDASSIMSTESI (PMEL_HUMAN)
  Core: PDASSIMST
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TARELPIPEPEGXDAXSXMSXESI

SEQ ID NO: 338235 - protein, 25 aa, Artificial Sequence
  Description of Artificial Sequence: Synthetic peptide
  Seed: TARELPIPEPEGPDASSIMSTESIT (PMEL_HUMAN)
  Core: PDASSIMST
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TARELPIPEPEGXDAXSXMSXESIT

SEQ ID NO: 338236 - protein, 13 aa, Artificial Sequence
  Description of Artificial Sequence: Synthetic peptide
  Seed: TATLRLVKRQVPL (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXL

SEQ ID NO: 338237 - protein, 14 aa, Artificial Sequence
  Description of Artificial Sequence: Synthetic peptide
  Seed: TATLRLVKRQVPLD (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLD

SEQ ID NO: 338238 - protein, 15 aa, Artificial Sequence
  Description of Artificial Sequence: Synthetic peptide
  Seed: TATLRLVKRQVPLDC (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDC

SEQ ID NO: 338239 - protein, 15 aa, Artificial Sequence
  Description of Artificial Sequence: Synthetic peptide
  Seed: TATLRLVKRQVPLDC (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXC

SEQ ID NO: 338240 - protein, 16 aa, Artificial Sequence
  Description of Artificial Sequence: Synthetic peptide
  Seed: TATLRLVKRQVPLDCV (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCV

SEQ ID NO: 338241 - protein, 16 aa, Artificial Sequence
  Description of Artificial Sequence: Synthetic peptide
  Seed: TATLRLVKRQVPLDCV (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCV

SEQ ID NO: 338242 - protein, 16 aa, Artificial Sequence
  Description of Artificial Sequence: Synthetic peptide
  Seed: TATLRLVKRQVPLDCV (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXV

SEQ ID NO: 338243 - protein, 17 aa, Artificial Sequence
  Description of Artificial Sequence: Synthetic peptide
  Seed: TATLRLVKRQVPLDCVL (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVL

SEQ ID NO: 338244 - protein, 17 aa, Artificial Sequence
  Description of Artificial Sequence: Synthetic peptide
  Seed: TATLRLVKRQVPLDCVL (PMEL_HUMAN)
  Core: RLVKRQVPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TATLXLVXRXVPXDCVL

SEQ ID NO: 338245 - protein, 17 aa, Artificial Sequence
  Description of Artificial Sequence: Synthetic peptide
  Seed: TATLRLVKRQVPLDCVL (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVL

SEQ ID NO: 338246 - protein, 17 aa, Artificial Sequence
  Description of Artificial Sequence: Synthetic peptide
  Seed: TATLRLVKRQVPLDCVL (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVL

SEQ ID NO: 338247 - protein, 18 aa, Artificial Sequence
  Description of Artificial Sequence: Synthetic peptide
  Seed: TATLRLVKRQVPLDCVLY (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLY

SEQ ID NO: 338248 - protein, 19 aa, Artificial Sequence
  Description of Artificial Sequence: Synthetic peptide
  Seed: TATLRLVKRQVPLDCVLYR (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYR

SEQ ID NO: 338249 - protein, 19 aa, Artificial Sequence
  Description of Artificial Sequence: Synthetic peptide
  Seed: TATLRLVKRQVPLDCVLYR (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYR

SEQ ID NO: 338250 - protein, 19 aa, Artificial Sequence
  Description of Artificial Sequence: Synthetic peptide
  Seed: TATLRLVKRQVPLDCVLYR (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYR

SEQ ID NO: 338251 - protein, 19 aa, Artificial Sequence
  Description of Artificial Sequence: Synthetic peptide
  Seed: TATLRLVKRQVPLDCVLYR (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYR

SEQ ID NO: 338252 - protein, 19 aa, Artificial Sequence
  Description of Artificial Sequence: Synthetic peptide
  Seed: TATLRLVKRQVPLDCVLYR (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXR

SEQ ID NO: 338253 - protein, 20 aa, Artificial Sequence
  Description of Artificial Sequence: Synthetic peptide
  Seed: TATLRLVKRQVPLDCVLYRY (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRY

SEQ ID NO: 338254 - protein, 20 aa, Artificial Sequence
  Description of Artificial Sequence: Synthetic peptide
  Seed: TATLRLVKRQVPLDCVLYRY (PMEL_HUMAN)
  Core: RLVKRQVPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TATLXLVXRXVPXDCVLYRY

SEQ ID NO: 338255 - protein, 20 aa, Artificial Sequence
  Description of Artificial Sequence: Synthetic peptide
  Seed: TATLRLVKRQVPLDCVLYRY (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRY

SEQ ID NO: 338256 - protein, 20 aa, Artificial Sequence
  Description of Artificial Sequence: Synthetic peptide
  Seed: TATLRLVKRQVPLDCVLYRY (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRY

SEQ ID NO: 338257 - protein, 20 aa, Artificial Sequence
  Description of Artificial Sequence: Synthetic peptide
  Seed: TATLRLVKRQVPLDCVLYRY (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRY

SEQ ID NO: 338258 - protein, 20 aa, Artificial Sequence
  Description of Artificial Sequence: Synthetic peptide
  Seed: TATLRLVKRQVPLDCVLYRY (PMEL_HUMAN)
  Core: RQVPLDCVL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKXQVXLXCVXYRY

SEQ ID NO: 338259 - protein, 20 aa, Artificial Sequence
  Description of Artificial Sequence: Synthetic peptide
  Seed: TATLRLVKRQVPLDCVLYRY (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRY

SEQ ID NO: 338260 - protein, 20 aa, Artificial Sequence
  Description of Artificial Sequence: Synthetic peptide
  Seed: TATLRLVKRQVPLDCVLYRY (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXY

SEQ ID NO: 338261 - protein, 21 aa, Artificial Sequence
  Description of Artificial Sequence: Synthetic peptide
  Seed: TATLRLVKRQVPLDCVLYRYG (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRYG

SEQ ID NO: 338262 - protein, 21 aa, Artificial Sequence
  Description of Artificial Sequence: Synthetic peptide
  Seed: TATLRLVKRQVPLDCVLYRYG (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRYG

SEQ ID NO: 338263 - protein, 21 aa, Artificial Sequence
  Description of Artificial Sequence: Synthetic peptide
  Seed: TATLRLVKRQVPLDCVLYRYG (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRYG

SEQ ID NO: 338264 - protein, 21 aa, Artificial Sequence
  Description of Artificial Sequence: Synthetic peptide
  Seed: TATLRLVKRQVPLDCVLYRYG (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRYG

SEQ ID NO: 338265 - protein, 21 aa, Artificial Sequence
  Description of Artificial Sequence: Synthetic peptide
  Seed: TATLRLVKRQVPLDCVLYRYG (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRYG

SEQ ID NO: 338266 - protein, 21 aa, Artificial Sequence
  Description of Artificial Sequence: Synthetic peptide
  Seed: TATLRLVKRQVPLDCVLYRYG (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXYG

SEQ ID NO: 338267 - protein, 22 aa, Artificial Sequence
  Description of Artificial Sequence: Synthetic peptide
  Seed: TATLRLVKRQVPLDCVLYRYGS (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRYGS

SEQ ID NO: 338268 - protein, 22 aa, Artificial Sequence
  Description of Artificial Sequence: Synthetic peptide
  Seed: TATLRLVKRQVPLDCVLYRYGS (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRYGS

SEQ ID NO: 338269 - protein, 22 aa, Artificial Sequence
  Description of Artificial Sequence: Synthetic peptide
  Seed: TATLRLVKRQVPLDCVLYRYGS (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRYGS

SEQ ID NO: 338270 - protein, 22 aa, Artificial Sequence
  Description of Artificial Sequence: Synthetic peptide
  Seed: TATLRLVKRQVPLDCVLYRYGS (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRYGS

SEQ ID NO: 338271 - protein, 22 aa, Artificial Sequence
  Description of Artificial Sequence: Synthetic peptide
  Seed: TATLRLVKRQVPLDCVLYRYGS (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRYGS

SEQ ID NO: 338272 - protein, 22 aa, Artificial Sequence
  Description of Artificial Sequence: Synthetic peptide
  Seed: TATLRLVKRQVPLDCVLYRYGS (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXYGS

SEQ ID NO: 338273 - protein, 22 aa, Artificial Sequence
  Description of Artificial Sequence: Synthetic peptide
  Seed: TATLRLVKRQVPLDCVLYRYGS (PMEL_HUMAN)
  Core: LDCVLYRYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVPXDCXLXRYXS

SEQ ID NO: 338274 - protein, 23 aa, Artificial Sequence
  Description of Artificial Sequence: Synthetic peptide
  Seed: TATLRLVKRQVPLDCVLYRYGSF (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRYGSF

SEQ ID NO: 338275 - protein, 23 aa, Artificial Sequence
  Description of Artificial Sequence: Synthetic peptide
  Seed: TATLRLVKRQVPLDCVLYRYGSF (PMEL_HUMAN)
  Core: RLVKRQVPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TATLXLVXRXVPXDCVLYRYGSF

SEQ ID NO: 338276 - protein, 23 aa, Artificial Sequence
  Description of Artificial Sequence: Synthetic peptide
  Seed: TATLRLVKRQVPLDCVLYRYGSF (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRYGSF

SEQ ID NO: 338277 - protein, 23 aa, Artificial Sequence
  Description of Artificial Sequence: Synthetic peptide
  Seed: TATLRLVKRQVPLDCVLYRYGSF (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRYGSF

SEQ ID NO: 338278 - protein, 23 aa, Artificial Sequence
  Description of Artificial Sequence: Synthetic peptide
  Seed: TATLRLVKRQVPLDCVLYRYGSF (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRYGSF

SEQ ID NO: 338279 - protein, 23 aa, Artificial Sequence
  Description of Artificial Sequence: Synthetic peptide
  Seed: TATLRLVKRQVPLDCVLYRYGSF (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRYGSF

SEQ ID NO: 338280 - protein, 23 aa, Artificial Sequence
  Description of Artificial Sequence: Synthetic peptide
  Seed: TATLRLVKRQVPLDCVLYRYGSF (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXYGSF

SEQ ID NO: 338281 - protein, 23 aa, Artificial Sequence
  Description of Artificial Sequence: Synthetic peptide
  Seed: TATLRLVKRQVPLDCVLYRYGSF (PMEL_HUMAN)
  Core: LDCVLYRYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVPXDCXLXRYXSF

SEQ ID NO: 338282 - protein, 24 aa, Artificial Sequence
  Description of Artificial Sequence: Synthetic peptide
  Seed: TATLRLVKRQVPLDCVLYRYGSFS (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRYGSFS

SEQ ID NO: 338283 - protein, 24 aa, Artificial Sequence
  Description of Artificial Sequence: Synthetic peptide
  Seed: TATLRLVKRQVPLDCVLYRYGSFS (PMEL_HUMAN)
  Core: RLVKRQVPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TATLXLVXRXVPXDCVLYRYGSFS

SEQ ID NO: 338284 - protein, 24 aa, Artificial Sequence
  Description of Artificial Sequence: Synthetic peptide
  Seed: TATLRLVKRQVPLDCVLYRYGSFS (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRYGSFS

SEQ ID NO: 338285 - protein, 24 aa, Artificial Sequence
  Description of Artificial Sequence: Synthetic peptide
  Seed: TATLRLVKRQVPLDCVLYRYGSFS (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRYGSFS

SEQ ID NO: 338286 - protein, 24 aa, Artificial Sequence
  Description of Artificial Sequence: Synthetic peptide
  Seed: TATLRLVKRQVPLDCVLYRYGSFS (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRYGSFS

SEQ ID NO: 338287 - protein, 24 aa, Artificial Sequence
  Description of Artificial Sequence: Synthetic peptide
  Seed: TATLRLVKRQVPLDCVLYRYGSFS (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRYGSFS

SEQ ID NO: 338288 - protein, 24 aa, Artificial Sequence
  Description of Artificial Sequence: Synthetic peptide
  Seed: TATLRLVKRQVPLDCVLYRYGSFS (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXYGSFS

SEQ ID NO: 338289 - protein, 24 aa, Artificial Sequence
  Description of Artificial Sequence: Synthetic peptide
  Seed: TATLRLVKRQVPLDCVLYRYGSFS (PMEL_HUMAN)
  Core: PLDCVLYRY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVXLDXVXYRXGSFS

SEQ ID NO: 338290 - protein, 24 aa, Artificial Sequence
  Description of Artificial Sequence: Synthetic peptide
  Seed: TATLRLVKRQVPLDCVLYRYGSFS (PMEL_HUMAN)
  Core: LDCVLYRYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVPXDCXLXRYXSFS

SEQ ID NO: 338291 - protein, 25 aa, Artificial Sequence
  Description of Artificial Sequence: Synthetic peptide
  Seed: TATLRLVKRQVPLDCVLYRYGSFSV (PMEL_HUMAN)
  Core: LRLVKRQVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TATXRLXKXQVXLDCVLYRYGSFSV

SEQ ID NO: 338292 - protein, 25 aa, Artificial Sequence
  Description of Artificial Sequence: Synthetic peptide
  Seed: TATLRLVKRQVPLDCVLYRYGSFSV (PMEL_HUMAN)
  Core: RLVKRQVPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TATLXLVXRXVPXDCVLYRYGSFSV

SEQ ID NO: 338293 - protein, 25 aa, Artificial Sequence
  Description of Artificial Sequence: Synthetic peptide
  Seed: TATLRLVKRQVPLDCVLYRYGSFSV (PMEL_HUMAN)
  Core: LVKRQVPLD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TATLRXVKXQXPLXCVLYRYGSFSV

SEQ ID NO: 338294 - protein, 25 aa, Artificial Sequence
  Description of Artificial Sequence: Synthetic peptide
  Seed: TATLRLVKRQVPLDCVLYRYGSFSV (PMEL_HUMAN)
  Core: VKRQVPLDC
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLXKRXVXLDXVLYRYGSFSV

SEQ ID NO: 338295 - protein, 25 aa, Artificial Sequence
  Description of Artificial Sequence: Synthetic peptide
  Seed: TATLRLVKRQVPLDCVLYRYGSFSV (PMEL_HUMAN)
  Core: KRQVPLDCV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVXRQXPXDCXLYRYGSFSV

SEQ ID NO: 338296 - protein, 25 aa, Artificial Sequence
  Description of Artificial Sequence: Synthetic peptide
  Seed: TATLRLVKRQVPLDCVLYRYGSFSV (PMEL_HUMAN)
  Core: QVPLDCVLY
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRXVPXDXVLXRYGSFSV

SEQ ID NO: 338297 - protein, 25 aa, Artificial Sequence
  Description of Artificial Sequence: Synthetic peptide
  Seed: TATLRLVKRQVPLDCVLYRYGSFSV (PMEL_HUMAN)
  Core: VPLDCVLYR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQXPLXCXLYXYGSFSV

SEQ ID NO: 338298 - protein, 25 aa, Artificial Sequence
  Description of Artificial Sequence: Synthetic peptide
  Seed: TATLRLVKRQVPLDCVLYRYGSFSV (PMEL_HUMAN)
  Core: LDCVLYRYG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVPXDCXLXRYXSFSV

SEQ ID NO: 338299 - protein, 25 aa, Artificial Sequence
  Description of Artificial Sequence: Synthetic peptide
  Seed: TATLRLVKRQVPLDCVLYRYGSFSV (PMEL_HUMAN)
  Core: LYRYGSFSV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
TATLRLVKRQVPLDCVXYRXGXFSX

SEQ ID NO: 338300 - protein, 21 aa, Artificial Sequence
  Description of Artificial Sequence: Synthetic peptide
  Seed: TDGHRPTAEAPNTTAGQVPTT (PMEL_HUMAN)
  Core: PTAEAPNTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDGHRXTAXAXNTXAGQVPTT

SEQ ID NO: 338301 - protein, 22 aa, Artificial Sequence
  Description of Artificial Sequence: Synthetic peptide
  Seed: TDGHRPTAEAPNTTAGQVPTTE (PMEL_HUMAN)
  Core: TTAGQVPTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDGHRPTAEAPNXTAXQXPTXE

SEQ ID NO: 338302 - protein, 23 aa, Artificial Sequence
  Description of Artificial Sequence: Synthetic peptide
  Seed: TDGHRPTAEAPNTTAGQVPTTEV (PMEL_HUMAN)
  Core: TTAGQVPTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDGHRPTAEAPNXTAXQXPTXEV

SEQ ID NO: 338303 - protein, 24 aa, Artificial Sequence
  Description of Artificial Sequence: Synthetic peptide
  Seed: TDGHRPTAEAPNTTAGQVPTTEVV (PMEL_HUMAN)
  Core: TTAGQVPTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDGHRPTAEAPNXTAXQXPTXEVV

SEQ ID NO: 338304 - protein, 25 aa, Artificial Sequence
  Description of Artificial Sequence: Synthetic peptide
  Seed: TDGHRPTAEAPNTTAGQVPTTEVVG (PMEL_HUMAN)
  Core: TTAGQVPTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDGHRPTAEAPNXTAXQXPTXEVVG

SEQ ID NO: 338305 - protein, 14 aa, Artificial Sequence
  Description of Artificial Sequence: Synthetic peptide
  Seed: TDQVPFSVSVSQLR (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXR

SEQ ID NO: 338306 - protein, 14 aa, Artificial Sequence
  Description of Artificial Sequence: Synthetic peptide
  Seed: TDQVPFSVSVSQLR (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLX

SEQ ID NO: 338307 - protein, 15 aa, Artificial Sequence
  Description of Artificial Sequence: Synthetic peptide
  Seed: TDQVPFSVSVSQLRA (PMEL_HUMAN)
  Core: QVPFSVSVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TDXVPXSXSVXQLRA

SEQ ID NO: 338308 - protein, 15 aa, Artificial Sequence
  Description of Artificial Sequence: Synthetic peptide
  Seed: TDQVPFSVSVSQLRA (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRA

SEQ ID NO: 338309 - protein, 15 aa, Artificial Sequence
  Description of Artificial Sequence: Synthetic peptide
  Seed: TDQVPFSVSVSQLRA (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXA

SEQ ID NO: 338310 - protein, 16 aa, Artificial Sequence
  Description of Artificial Sequence: Synthetic peptide
  Seed: TDQVPFSVSVSQLRAL (PMEL_HUMAN)
  Core: QVPFSVSVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TDXVPXSXSVXQLRAL

SEQ ID NO: 338311 - protein, 16 aa, Artificial Sequence
  Description of Artificial Sequence: Synthetic peptide
  Seed: TDQVPFSVSVSQLRAL (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRAL

SEQ ID NO: 338312 - protein, 16 aa, Artificial Sequence
  Description of Artificial Sequence: Synthetic peptide
  Seed: TDQVPFSVSVSQLRAL (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXAL

SEQ ID NO: 338313 - protein, 16 aa, Artificial Sequence
  Description of Artificial Sequence: Synthetic peptide
  Seed: TDQVPFSVSVSQLRAL (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAX

SEQ ID NO: 338314 - protein, 17 aa, Artificial Sequence
  Description of Artificial Sequence: Synthetic peptide
  Seed: TDQVPFSVSVSQLRALD (PMEL_HUMAN)
  Core: QVPFSVSVS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TDXVPXSXSVXQLRALD

SEQ ID NO: 338315 - protein, 17 aa, Artificial Sequence
  Description of Artificial Sequence: Synthetic peptide
  Seed: TDQVPFSVSVSQLRALD (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALD

SEQ ID NO: 338316 - protein, 17 aa, Artificial Sequence
  Description of Artificial Sequence: Synthetic peptide
  Seed: TDQVPFSVSVSQLRALD (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALD

SEQ ID NO: 338317 - protein, 17 aa, Artificial Sequence
  Description of Artificial Sequence: Synthetic peptide
  Seed: TDQVPFSVSVSQLRALD (PMEL_HUMAN)
  Core: SVSVSQLRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFXVSXSXLRXLD

SEQ ID NO: 338318 - protein, 17 aa, Artificial Sequence
  Description of Artificial Sequence: Synthetic peptide
  Seed: TDQVPFSVSVSQLRALD (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXD

SEQ ID NO: 338319 - protein, 18 aa, Artificial Sequence
  Description of Artificial Sequence: Synthetic peptide
  Seed: TDQVPFSVSVSQLRALDG (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDG

SEQ ID NO: 338320 - protein, 18 aa, Artificial Sequence
  Description of Artificial Sequence: Synthetic peptide
  Seed: TDQVPFSVSVSQLRALDG (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDG

SEQ ID NO: 338321 - protein, 18 aa, Artificial Sequence
  Description of Artificial Sequence: Synthetic peptide
  Seed: TDQVPFSVSVSQLRALDG (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDG

SEQ ID NO: 338322 - protein, 19 aa, Artificial Sequence
  Description of Artificial Sequence: Synthetic peptide
  Seed: TDQVPFSVSVSQLRALDGG (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGG

SEQ ID NO: 338323 - protein, 19 aa, Artificial Sequence
  Description of Artificial Sequence: Synthetic peptide
  Seed: TDQVPFSVSVSQLRALDGG (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGG

SEQ ID NO: 338324 - protein, 19 aa, Artificial Sequence
  Description of Artificial Sequence: Synthetic peptide
  Seed: TDQVPFSVSVSQLRALDGG (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGG

SEQ ID NO: 338325 - protein, 19 aa, Artificial Sequence
  Description of Artificial Sequence: Synthetic peptide
  Seed: TDQVPFSVSVSQLRALDGG (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXG

SEQ ID NO: 338326 - protein, 20 aa, Artificial Sequence
  Description of Artificial Sequence: Synthetic peptide
  Seed: TDQVPFSVSVSQLRALDGGN (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGN

SEQ ID NO: 338327 - protein, 20 aa, Artificial Sequence
  Description of Artificial Sequence: Synthetic peptide
  Seed: TDQVPFSVSVSQLRALDGGN (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGN

SEQ ID NO: 338328 - protein, 20 aa, Artificial Sequence
  Description of Artificial Sequence: Synthetic peptide
  Seed: TDQVPFSVSVSQLRALDGGN (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGN

SEQ ID NO: 338329 - protein, 20 aa, Artificial Sequence
  Description of Artificial Sequence: Synthetic peptide
  Seed: TDQVPFSVSVSQLRALDGGN (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGN

SEQ ID NO: 338330 - protein, 21 aa, Artificial Sequence
  Description of Artificial Sequence: Synthetic peptide
  Seed: TDQVPFSVSVSQLRALDGGNK (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGNK

SEQ ID NO: 338331 - protein, 21 aa, Artificial Sequence
  Description of Artificial Sequence: Synthetic peptide
  Seed: TDQVPFSVSVSQLRALDGGNK (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGNK

SEQ ID NO: 338332 - protein, 21 aa, Artificial Sequence
  Description of Artificial Sequence: Synthetic peptide
  Seed: TDQVPFSVSVSQLRALDGGNK (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGNK

SEQ ID NO: 338333 - protein, 21 aa, Artificial Sequence
  Description of Artificial Sequence: Synthetic peptide
  Seed: TDQVPFSVSVSQLRALDGGNK (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGNK

SEQ ID NO: 338334 - protein, 22 aa, Artificial Sequence
  Description of Artificial Sequence: Synthetic peptide
  Seed: TDQVPFSVSVSQLRALDGGNKH (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGNKH

SEQ ID NO: 338335 - protein, 22 aa, Artificial Sequence
  Description of Artificial Sequence: Synthetic peptide
  Seed: TDQVPFSVSVSQLRALDGGNKH (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGNKH

SEQ ID NO: 338336 - protein, 22 aa, Artificial Sequence
  Description of Artificial Sequence: Synthetic peptide
  Seed: TDQVPFSVSVSQLRALDGGNKH (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGNKH

SEQ ID NO: 338337 - protein, 22 aa, Artificial Sequence
  Description of Artificial Sequence: Synthetic peptide
  Seed: TDQVPFSVSVSQLRALDGGNKH (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGNKH

SEQ ID NO: 338338 - protein, 23 aa, Artificial Sequence
  Description of Artificial Sequence: Synthetic peptide
  Seed: TDQVPFSVSVSQLRALDGGNKHF (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGNKHF

SEQ ID NO: 338339 - protein, 23 aa, Artificial Sequence
  Description of Artificial Sequence: Synthetic peptide
  Seed: TDQVPFSVSVSQLRALDGGNKHF (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGNKHF

SEQ ID NO: 338340 - protein, 23 aa, Artificial Sequence
  Description of Artificial Sequence: Synthetic peptide
  Seed: TDQVPFSVSVSQLRALDGGNKHF (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGNKHF

SEQ ID NO: 338341 - protein, 23 aa, Artificial Sequence
  Description of Artificial Sequence: Synthetic peptide
  Seed: TDQVPFSVSVSQLRALDGGNKHF (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGNKHF

SEQ ID NO: 338342 - protein, 23 aa, Artificial Sequence
  Description of Artificial Sequence: Synthetic peptide
  Seed: TDQVPFSVSVSQLRALDGGNKHF (PMEL_HUMAN)
  Core: LRALDGGNK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSVSQXRAXDXGNXHF

SEQ ID NO: 338343 - protein, 24 aa, Artificial Sequence
  Description of Artificial Sequence: Synthetic peptide
  Seed: TDQVPFSVSVSQLRALDGGNKHFL (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGNKHFL

SEQ ID NO: 338344 - protein, 24 aa, Artificial Sequence
  Description of Artificial Sequence: Synthetic peptide
  Seed: TDQVPFSVSVSQLRALDGGNKHFL (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGNKHFL

SEQ ID NO: 338345 - protein, 24 aa, Artificial Sequence
  Description of Artificial Sequence: Synthetic peptide
  Seed: TDQVPFSVSVSQLRALDGGNKHFL (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGNKHFL

SEQ ID NO: 338346 - protein, 24 aa, Artificial Sequence
  Description of Artificial Sequence: Synthetic peptide
  Seed: TDQVPFSVSVSQLRALDGGNKHFL (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGNKHFL

SEQ ID NO: 338347 - protein, 24 aa, Artificial Sequence
  Description of Artificial Sequence: Synthetic peptide
  Seed: TDQVPFSVSVSQLRALDGGNKHFL (PMEL_HUMAN)
  Core: LRALDGGNK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSVSQXRAXDXGNXHFL

SEQ ID NO: 338348 - protein, 25 aa, Artificial Sequence
  Description of Artificial Sequence: Synthetic peptide
  Seed: TDQVPFSVSVSQLRALDGGNKHFLR (PMEL_HUMAN)
  Core: PFSVSVSQL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TDQVXFSXSXSQXRALDGGNKHFLR

SEQ ID NO: 338349 - protein, 25 aa, Artificial Sequence
  Description of Artificial Sequence: Synthetic peptide
  Seed: TDQVPFSVSVSQLRALDGGNKHFLR (PMEL_HUMAN)
  Core: FSVSVSQLR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPXSVXVXQLXALDGGNKHFLR

SEQ ID NO: 338350 - protein, 25 aa, Artificial Sequence
  Description of Artificial Sequence: Synthetic peptide
  Seed: TDQVPFSVSVSQLRALDGGNKHFLR (PMEL_HUMAN)
  Core: VSVSQLRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSXSVXQXRAXDGGNKHFLR

SEQ ID NO: 338351 - protein, 25 aa, Artificial Sequence
  Description of Artificial Sequence: Synthetic peptide
  Seed: TDQVPFSVSVSQLRALDGGNKHFLR (PMEL_HUMAN)
  Core: VSQLRALDG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSXSQXRXLDXGNKHFLR

SEQ ID NO: 338352 - protein, 25 aa, Artificial Sequence
  Description of Artificial Sequence: Synthetic peptide
  Seed: TDQVPFSVSVSQLRALDGGNKHFLR (PMEL_HUMAN)
  Core: LRALDGGNK
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSVSQXRAXDXGNXHFLR

SEQ ID NO: 338353 - protein, 25 aa, Artificial Sequence
  Description of Artificial Sequence: Synthetic peptide
  Seed: TDQVPFSVSVSQLRALDGGNKHFLR (PMEL_HUMAN)
  Core: RALDGGNKH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TDQVPFSVSVSQLXALXGXNKXFLR

SEQ ID NO: 338354 - protein, 17 aa, Artificial Sequence
  Description of Artificial Sequence: Synthetic peptide
  Seed: TEAQRLDCWRGGQVSLK (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLX

SEQ ID NO: 338355 - protein, 19 aa, Artificial Sequence
  Description of Artificial Sequence: Synthetic peptide
  Seed: TEAQRLDCWRGGQVSLKVS (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVS

SEQ ID NO: 338356 - protein, 20 aa, Artificial Sequence
  Description of Artificial Sequence: Synthetic peptide
  Seed: TEAQRLDCWRGGQVSLKVSN (PMEL_HUMAN)
  Core: LDCWRGGQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRXDCXRXGQXSLKVSN

SEQ ID NO: 338357 - protein, 20 aa, Artificial Sequence
  Description of Artificial Sequence: Synthetic peptide
  Seed: TEAQRLDCWRGGQVSLKVSN (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSN

SEQ ID NO: 338358 - protein, 21 aa, Artificial Sequence
  Description of Artificial Sequence: Synthetic peptide
  Seed: TEAQRLDCWRGGQVSLKVSND (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSND

SEQ ID NO: 338359 - protein, 22 aa, Artificial Sequence
  Description of Artificial Sequence: Synthetic peptide
  Seed: TEAQRLDCWRGGQVSLKVSNDG (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSNDG

SEQ ID NO: 338360 - protein, 23 aa, Artificial Sequence
  Description of Artificial Sequence: Synthetic peptide
  Seed: TEAQRLDCWRGGQVSLKVSNDGP (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSNDGP

SEQ ID NO: 338361 - protein, 24 aa, Artificial Sequence
  Description of Artificial Sequence: Synthetic peptide
  Seed: TEAQRLDCWRGGQVSLKVSNDGPT (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSNDGPT

SEQ ID NO: 338362 - protein, 25 aa, Artificial Sequence
  Description of Artificial Sequence: Synthetic peptide
  Seed: TEAQRLDCWRGGQVSLKVSNDGPTL (PMEL_HUMAN)
  Core: WRGGQVSLK
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEAQRLDCXRGXQXSLXVSNDGPTL

SEQ ID NO: 338363 - protein, 14 aa, Artificial Sequence
  Description of Artificial Sequence: Synthetic peptide
  Seed: TESITGSLGPLLDG (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDG

SEQ ID NO: 338364 - protein, 15 aa, Artificial Sequence
  Description of Artificial Sequence: Synthetic peptide
  Seed: TESITGSLGPLLDGT (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGT

SEQ ID NO: 338365 - protein, 16 aa, Artificial Sequence
  Description of Artificial Sequence: Synthetic peptide
  Seed: TESITGSLGPLLDGTA (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTA

SEQ ID NO: 338366 - protein, 17 aa, Artificial Sequence
  Description of Artificial Sequence: Synthetic peptide
  Seed: TESITGSLGPLLDGTAT (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTAT

SEQ ID NO: 338367 - protein, 19 aa, Artificial Sequence
  Description of Artificial Sequence: Synthetic peptide
  Seed: TESITGSLGPLLDGTATLR (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLR

SEQ ID NO: 338368 - protein, 20 aa, Artificial Sequence
  Description of Artificial Sequence: Synthetic peptide
  Seed: TESITGSLGPLLDGTATLRL (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRL

SEQ ID NO: 338369 - protein, 20 aa, Artificial Sequence
  Description of Artificial Sequence: Synthetic peptide
  Seed: TESITGSLGPLLDGTATLRL (PMEL_HUMAN)
  Core: LGPLLDGTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSXGPXLXGTXTLRL

SEQ ID NO: 338370 - protein, 20 aa, Artificial Sequence
  Description of Artificial Sequence: Synthetic peptide
  Seed: TESITGSLGPLLDGTATLRL (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRX

SEQ ID NO: 338371 - protein, 21 aa, Artificial Sequence
  Description of Artificial Sequence: Synthetic peptide
  Seed: TESITGSLGPLLDGTATLRLV (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRLV

SEQ ID NO: 338372 - protein, 21 aa, Artificial Sequence
  Description of Artificial Sequence: Synthetic peptide
  Seed: TESITGSLGPLLDGTATLRLV (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRXV

SEQ ID NO: 338373 - protein, 22 aa, Artificial Sequence
  Description of Artificial Sequence: Synthetic peptide
  Seed: TESITGSLGPLLDGTATLRLVK (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRLVK

SEQ ID NO: 338374 - protein, 22 aa, Artificial Sequence
  Description of Artificial Sequence: Synthetic peptide
  Seed: TESITGSLGPLLDGTATLRLVK (PMEL_HUMAN)
  Core: LGPLLDGTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSXGPXLXGTXTLRLVK

SEQ ID NO: 338375 - protein, 22 aa, Artificial Sequence
  Description of Artificial Sequence: Synthetic peptide
  Seed: TESITGSLGPLLDGTATLRLVK (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRXVK

SEQ ID NO: 338376 - protein, 23 aa, Artificial Sequence
  Description of Artificial Sequence: Synthetic peptide
  Seed: TESITGSLGPLLDGTATLRLVKR (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRLVKR

SEQ ID NO: 338377 - protein, 23 aa, Artificial Sequence
  Description of Artificial Sequence: Synthetic peptide
  Seed: TESITGSLGPLLDGTATLRLVKR (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRXVKR

SEQ ID NO: 338378 - protein, 24 aa, Artificial Sequence
  Description of Artificial Sequence: Synthetic peptide
  Seed: TESITGSLGPLLDGTATLRLVKRQ (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRLVKRQ

SEQ ID NO: 338379 - protein, 24 aa, Artificial Sequence
  Description of Artificial Sequence: Synthetic peptide
  Seed: TESITGSLGPLLDGTATLRLVKRQ (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRXVKRQ

SEQ ID NO: 338380 - protein, 24 aa, Artificial Sequence
  Description of Artificial Sequence: Synthetic peptide
  Seed: TESITGSLGPLLDGTATLRLVKRQ (PMEL_HUMAN)
  Core: DGTATLRLV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLLXGTXTXRLXKRQ

SEQ ID NO: 338381 - protein, 25 aa, Artificial Sequence
  Description of Artificial Sequence: Synthetic peptide
  Seed: TESITGSLGPLLDGTATLRLVKRQV (PMEL_HUMAN)
  Core: ITGSLGPLL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TESXTGXLXPLXDGTATLRLVKRQV

SEQ ID NO: 338382 - protein, 25 aa, Artificial Sequence
  Description of Artificial Sequence: Synthetic peptide
  Seed: TESITGSLGPLLDGTATLRLVKRQV (PMEL_HUMAN)
  Core: LGPLLDGTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSXGPXLXGTXTLRLVKRQV

SEQ ID NO: 338383 - protein, 25 aa, Artificial Sequence
  Description of Artificial Sequence: Synthetic peptide
  Seed: TESITGSLGPLLDGTATLRLVKRQV (PMEL_HUMAN)
  Core: LDGTATLRL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLXDGXAXLRXVKRQV

SEQ ID NO: 338384 - protein, 25 aa, Artificial Sequence
  Description of Artificial Sequence: Synthetic peptide
  Seed: TESITGSLGPLLDGTATLRLVKRQV (PMEL_HUMAN)
  Core: DGTATLRLV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TESITGSLGPLLXGTXTXRLXKRQV

SEQ ID NO: 338385 - protein, 13 aa, Artificial Sequence
  Description of Artificial Sequence: Synthetic peptide
  Seed: TEVISTAPVQMPT (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPT

SEQ ID NO: 338386 - protein, 14 aa, Artificial Sequence
  Description of Artificial Sequence: Synthetic peptide
  Seed: TEVISTAPVQMPTA (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTA

SEQ ID NO: 338387 - protein, 14 aa, Artificial Sequence
  Description of Artificial Sequence: Synthetic peptide
  Seed: TEVISTAPVQMPTA (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTA

SEQ ID NO: 338388 - protein, 15 aa, Artificial Sequence
  Description of Artificial Sequence: Synthetic peptide
  Seed: TEVISTAPVQMPTAE (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAE

SEQ ID NO: 338389 - protein, 15 aa, Artificial Sequence
  Description of Artificial Sequence: Synthetic peptide
  Seed: TEVISTAPVQMPTAE (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAE

SEQ ID NO: 338390 - protein, 16 aa, Artificial Sequence
  Description of Artificial Sequence: Synthetic peptide
  Seed: TEVISTAPVQMPTAES (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAES

SEQ ID NO: 338391 - protein, 16 aa, Artificial Sequence
  Description of Artificial Sequence: Synthetic peptide
  Seed: TEVISTAPVQMPTAES (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAES

SEQ ID NO: 338392 - protein, 16 aa, Artificial Sequence
  Description of Artificial Sequence: Synthetic peptide
  Seed: TEVISTAPVQMPTAES (PMEL_HUMAN)
  Core: TAPVQMPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVISXAPXQXPTXES

SEQ ID NO: 338393 - protein, 17 aa, Artificial Sequence
  Description of Artificial Sequence: Synthetic peptide
  Seed: TEVISTAPVQMPTAEST (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAEST

SEQ ID NO: 338394 - protein, 17 aa, Artificial Sequence
  Description of Artificial Sequence: Synthetic peptide
  Seed: TEVISTAPVQMPTAEST (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAEST

SEQ ID NO: 338395 - protein, 17 aa, Artificial Sequence
  Description of Artificial Sequence: Synthetic peptide
  Seed: TEVISTAPVQMPTAEST (PMEL_HUMAN)
  Core: TAPVQMPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVISXAPXQXPTXEST

SEQ ID NO: 338396 - protein, 18 aa, Artificial Sequence
  Description of Artificial Sequence: Synthetic peptide
  Seed: TEVISTAPVQMPTAESTG (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTG

SEQ ID NO: 338397 - protein, 19 aa, Artificial Sequence
  Description of Artificial Sequence: Synthetic peptide
  Seed: TEVISTAPVQMPTAESTGM (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGM

SEQ ID NO: 338398 - protein, 19 aa, Artificial Sequence
  Description of Artificial Sequence: Synthetic peptide
  Seed: TEVISTAPVQMPTAESTGM (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGM

SEQ ID NO: 338399 - protein, 19 aa, Artificial Sequence
  Description of Artificial Sequence: Synthetic peptide
  Seed: TEVISTAPVQMPTAESTGM (PMEL_HUMAN)
  Core: TAPVQMPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVISXAPXQXPTXESTGM

SEQ ID NO: 338400 - protein, 19 aa, Artificial Sequence
  Description of Artificial Sequence: Synthetic peptide
  Seed: TEVISTAPVQMPTAESTGM (PMEL_HUMAN)
  Core: PVQMPTAES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAXVQXPXAEXTGM

SEQ ID NO: 338401 - protein, 20 aa, Artificial Sequence
  Description of Artificial Sequence: Synthetic peptide
  Seed: TEVISTAPVQMPTAESTGMT (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMT

SEQ ID NO: 338402 - protein, 20 aa, Artificial Sequence
  Description of Artificial Sequence: Synthetic peptide
  Seed: TEVISTAPVQMPTAESTGMT (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMT

SEQ ID NO: 338403 - protein, 20 aa, Artificial Sequence
  Description of Artificial Sequence: Synthetic peptide
  Seed: TEVISTAPVQMPTAESTGMT (PMEL_HUMAN)
  Core: TAPVQMPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVISXAPXQXPTXESTGMT

SEQ ID NO: 338404 - protein, 20 aa, Artificial Sequence
  Description of Artificial Sequence: Synthetic peptide
  Seed: TEVISTAPVQMPTAESTGMT (PMEL_HUMAN)
  Core: PVQMPTAES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAXVQXPXAEXTGMT

SEQ ID NO: 338405 - protein, 20 aa, Artificial Sequence
  Description of Artificial Sequence: Synthetic peptide
  Seed: TEVISTAPVQMPTAESTGMT (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMT

SEQ ID NO: 338406 - protein, 21 aa, Artificial Sequence
  Description of Artificial Sequence: Synthetic peptide
  Seed: TEVISTAPVQMPTAESTGMTP (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMTP

SEQ ID NO: 338407 - protein, 21 aa, Artificial Sequence
  Description of Artificial Sequence: Synthetic peptide
  Seed: TEVISTAPVQMPTAESTGMTP (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMTP

SEQ ID NO: 338408 - protein, 21 aa, Artificial Sequence
  Description of Artificial Sequence: Synthetic peptide
  Seed: TEVISTAPVQMPTAESTGMTP (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMTP

SEQ ID NO: 338409 - protein, 22 aa, Artificial Sequence
  Description of Artificial Sequence: Synthetic peptide
  Seed: TEVISTAPVQMPTAESTGMTPE (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMTPE

SEQ ID NO: 338410 - protein, 22 aa, Artificial Sequence
  Description of Artificial Sequence: Synthetic peptide
  Seed: TEVISTAPVQMPTAESTGMTPE (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMTPE

SEQ ID NO: 338411 - protein, 22 aa, Artificial Sequence
  Description of Artificial Sequence: Synthetic peptide
  Seed: TEVISTAPVQMPTAESTGMTPE (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMTPE

SEQ ID NO: 338412 - protein, 23 aa, Artificial Sequence
  Description of Artificial Sequence: Synthetic peptide
  Seed: TEVISTAPVQMPTAESTGMTPEK (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMTPEK

SEQ ID NO: 338413 - protein, 23 aa, Artificial Sequence
  Description of Artificial Sequence: Synthetic peptide
  Seed: TEVISTAPVQMPTAESTGMTPEK (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMTPEK

SEQ ID NO: 338414 - protein, 23 aa, Artificial Sequence
  Description of Artificial Sequence: Synthetic peptide
  Seed: TEVISTAPVQMPTAESTGMTPEK (PMEL_HUMAN)
  Core: PVQMPTAES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAXVQXPXAEXTGMTPEK

SEQ ID NO: 338415 - protein, 23 aa, Artificial Sequence
  Description of Artificial Sequence: Synthetic peptide
  Seed: TEVISTAPVQMPTAESTGMTPEK (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMTPEK

SEQ ID NO: 338416 - protein, 24 aa, Artificial Sequence
  Description of Artificial Sequence: Synthetic peptide
  Seed: TEVISTAPVQMPTAESTGMTPEKV (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMTPEKV

SEQ ID NO: 338417 - protein, 24 aa, Artificial Sequence
  Description of Artificial Sequence: Synthetic peptide
  Seed: TEVISTAPVQMPTAESTGMTPEKV (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMTPEKV

SEQ ID NO: 338418 - protein, 24 aa, Artificial Sequence
  Description of Artificial Sequence: Synthetic peptide
  Seed: TEVISTAPVQMPTAESTGMTPEKV (PMEL_HUMAN)
  Core: PVQMPTAES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAXVQXPXAEXTGMTPEKV

SEQ ID NO: 338419 - protein, 24 aa, Artificial Sequence
  Description of Artificial Sequence: Synthetic peptide
  Seed: TEVISTAPVQMPTAESTGMTPEKV (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMTPEKV

SEQ ID NO: 338420 - protein, 25 aa, Artificial Sequence
  Description of Artificial Sequence: Synthetic peptide
  Seed: TEVISTAPVQMPTAESTGMTPEKVP (PMEL_HUMAN)
  Core: VISTAPVQM
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXISXAXVQXPTAESTGMTPEKVP

SEQ ID NO: 338421 - protein, 25 aa, Artificial Sequence
  Description of Artificial Sequence: Synthetic peptide
  Seed: TEVISTAPVQMPTAESTGMTPEKVP (PMEL_HUMAN)
  Core: ISTAPVQMP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TEVXSTXPXQMXTAESTGMTPEKVP

SEQ ID NO: 338422 - protein, 25 aa, Artificial Sequence
  Description of Artificial Sequence: Synthetic peptide
  Seed: TEVISTAPVQMPTAESTGMTPEKVP (PMEL_HUMAN)
  Core: PVQMPTAES
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAXVQXPXAEXTGMTPEKVP

SEQ ID NO: 338423 - protein, 25 aa, Artificial Sequence
  Description of Artificial Sequence: Synthetic peptide
  Seed: TEVISTAPVQMPTAESTGMTPEKVP (PMEL_HUMAN)
  Core: VQMPTAEST
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPXQMXTXESXGMTPEKVP

SEQ ID NO: 338424 - protein, 25 aa, Artificial Sequence
  Description of Artificial Sequence: Synthetic peptide
  Seed: TEVISTAPVQMPTAESTGMTPEKVP (PMEL_HUMAN)
  Core: STGMTPEKV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TEVISTAPVQMPTAEXTGXTXEKXP

SEQ ID NO: 338425 - protein, 14 aa, Artificial Sequence
  Description of Artificial Sequence: Synthetic peptide
  Seed: TEVVGTTPGQAPTA (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTA

SEQ ID NO: 338426 - protein, 15 aa, Artificial Sequence
  Description of Artificial Sequence: Synthetic peptide
  Seed: TEVVGTTPGQAPTAE (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAE

SEQ ID NO: 338427 - protein, 16 aa, Artificial Sequence
  Description of Artificial Sequence: Synthetic peptide
  Seed: TEVVGTTPGQAPTAEP (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEP

SEQ ID NO: 338428 - protein, 16 aa, Artificial Sequence
  Description of Artificial Sequence: Synthetic peptide
  Seed: TEVVGTTPGQAPTAEP (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEP

SEQ ID NO: 338429 - protein, 17 aa, Artificial Sequence
  Description of Artificial Sequence: Synthetic peptide
  Seed: TEVVGTTPGQAPTAEPS (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPS

SEQ ID NO: 338430 - protein, 17 aa, Artificial Sequence
  Description of Artificial Sequence: Synthetic peptide
  Seed: TEVVGTTPGQAPTAEPS (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPS

SEQ ID NO: 338431 - protein, 18 aa, Artificial Sequence
  Description of Artificial Sequence: Synthetic peptide
  Seed: TEVVGTTPGQAPTAEPSG (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSG

SEQ ID NO: 338432 - protein, 19 aa, Artificial Sequence
  Description of Artificial Sequence: Synthetic peptide
  Seed: TEVVGTTPGQAPTAEPSGT (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGT

SEQ ID NO: 338433 - protein, 19 aa, Artificial Sequence
  Description of Artificial Sequence: Synthetic peptide
  Seed: TEVVGTTPGQAPTAEPSGT (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGT

SEQ ID NO: 338434 - protein, 20 aa, Artificial Sequence
  Description of Artificial Sequence: Synthetic peptide
  Seed: TEVVGTTPGQAPTAEPSGTT (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTT

SEQ ID NO: 338435 - protein, 20 aa, Artificial Sequence
  Description of Artificial Sequence: Synthetic peptide
  Seed: TEVVGTTPGQAPTAEPSGTT (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTT

SEQ ID NO: 338436 - protein, 21 aa, Artificial Sequence
  Description of Artificial Sequence: Synthetic peptide
  Seed: TEVVGTTPGQAPTAEPSGTTS (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTTS

SEQ ID NO: 338437 - protein, 21 aa, Artificial Sequence
  Description of Artificial Sequence: Synthetic peptide
  Seed: TEVVGTTPGQAPTAEPSGTTS (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTTS

SEQ ID NO: 338438 - protein, 22 aa, Artificial Sequence
  Description of Artificial Sequence: Synthetic peptide
  Seed: TEVVGTTPGQAPTAEPSGTTSV (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTTSV

SEQ ID NO: 338439 - protein, 22 aa, Artificial Sequence
  Description of Artificial Sequence: Synthetic peptide
  Seed: TEVVGTTPGQAPTAEPSGTTSV (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTTSV

SEQ ID NO: 338440 - protein, 23 aa, Artificial Sequence
  Description of Artificial Sequence: Synthetic peptide
  Seed: TEVVGTTPGQAPTAEPSGTTSVQ (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTTSVQ

SEQ ID NO: 338441 - protein, 23 aa, Artificial Sequence
  Description of Artificial Sequence: Synthetic peptide
  Seed: TEVVGTTPGQAPTAEPSGTTSVQ (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTTSVQ

SEQ ID NO: 338442 - protein, 24 aa, Artificial Sequence
  Description of Artificial Sequence: Synthetic peptide
  Seed: TEVVGTTPGQAPTAEPSGTTSVQV (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTTSVQV

SEQ ID NO: 338443 - protein, 24 aa, Artificial Sequence
  Description of Artificial Sequence: Synthetic peptide
  Seed: TEVVGTTPGQAPTAEPSGTTSVQV (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTTSVQV

SEQ ID NO: 338444 - protein, 25 aa, Artificial Sequence
  Description of Artificial Sequence: Synthetic peptide
  Seed: TEVVGTTPGQAPTAEPSGTTSVQVP (PMEL_HUMAN)
  Core: VVGTTPGQA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVGXTXGQXPTAEPSGTTSVQVP

SEQ ID NO: 338445 - protein, 25 aa, Artificial Sequence
  Description of Artificial Sequence: Synthetic peptide
  Seed: TEVVGTTPGQAPTAEPSGTTSVQVP (PMEL_HUMAN)
  Core: TTPGQAPTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TEVVGXTPXQXPTXEPSGTTSVQVP

SEQ ID NO: 338446 - protein, 13 aa, Artificial Sequence
  Description of Artificial Sequence: Synthetic peptide
  Seed: TEWVETTARELPI (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPI

SEQ ID NO: 338447 - protein, 14 aa, Artificial Sequence
  Description of Artificial Sequence: Synthetic peptide
  Seed: TEWVETTARELPIP (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIP

SEQ ID NO: 338448 - protein, 15 aa, Artificial Sequence
  Description of Artificial Sequence: Synthetic peptide
  Seed: TEWVETTARELPIPE (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPE

SEQ ID NO: 338449 - protein, 16 aa, Artificial Sequence
  Description of Artificial Sequence: Synthetic peptide
  Seed: TEWVETTARELPIPEP (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEP

SEQ ID NO: 338450 - protein, 16 aa, Artificial Sequence
  Description of Artificial Sequence: Synthetic peptide
  Seed: TEWVETTARELPIPEP (PMEL_HUMAN)
  Core: ETTARELPI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TEWVXTTXRXLPXPEP

SEQ ID NO: 338451 - protein, 17 aa, Artificial Sequence
  Description of Artificial Sequence: Synthetic peptide
  Seed: TEWVETTARELPIPEPE (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPE

SEQ ID NO: 338452 - protein, 18 aa, Artificial Sequence
  Description of Artificial Sequence: Synthetic peptide
  Seed: TEWVETTARELPIPEPEG (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEG

SEQ ID NO: 338453 - protein, 19 aa, Artificial Sequence
  Description of Artificial Sequence: Synthetic peptide
  Seed: TEWVETTARELPIPEPEGP (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGP

SEQ ID NO: 338454 - protein, 20 aa, Artificial Sequence
  Description of Artificial Sequence: Synthetic peptide
  Seed: TEWVETTARELPIPEPEGPD (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPD

SEQ ID NO: 338455 - protein, 20 aa, Artificial Sequence
  Description of Artificial Sequence: Synthetic peptide
  Seed: TEWVETTARELPIPEPEGPD (PMEL_HUMAN)
  Core: RELPIPEPE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TEWVETTAXELXIXEPXGPD

SEQ ID NO: 338456 - protein, 21 aa, Artificial Sequence
  Description of Artificial Sequence: Synthetic peptide
  Seed: TEWVETTARELPIPEPEGPDA (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPDA

SEQ ID NO: 338457 - protein, 22 aa, Artificial Sequence
  Description of Artificial Sequence: Synthetic peptide
  Seed: TEWVETTARELPIPEPEGPDAS (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPDAS

SEQ ID NO: 338458 - protein, 23 aa, Artificial Sequence
  Description of Artificial Sequence: Synthetic peptide
  Seed: TEWVETTARELPIPEPEGPDASS (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPDASS

SEQ ID NO: 338459 - protein, 24 aa, Artificial Sequence
  Description of Artificial Sequence: Synthetic peptide
  Seed: TEWVETTARELPIPEPEGPDASSI (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPDASSI

SEQ ID NO: 338460 - protein, 25 aa, Artificial Sequence
  Description of Artificial Sequence: Synthetic peptide
  Seed: TEWVETTARELPIPEPEGPDASSIM (PMEL_HUMAN)
  Core: WVETTAREL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TEXVEXTXREXPIPEPEGPDASSIM

SEQ ID NO: 338461 - protein, 14 aa, Artificial Sequence
  Description of Artificial Sequence: Synthetic peptide
  Seed: TFALQLHDPSGYLA (PMEL_HUMAN)
  Core: FALQLHDPS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXALXLXDPXGYLA

SEQ ID NO: 338462 - protein, 14 aa, Artificial Sequence
  Description of Artificial Sequence: Synthetic peptide
  Seed: TFALQLHDPSGYLA (PMEL_HUMAN)
  Core: ALQLHDPSG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TFXLQXHXPSXYLA

SEQ ID NO: 338463 - protein, 14 aa, Artificial Sequence
  Description of Artificial Sequence: Synthetic peptide
  Seed: TFALQLHDPSGYLA (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLA

SEQ ID NO: 338464 - protein, 15 aa, Artificial Sequence
  Description of Artificial Sequence: Synthetic peptide
  Seed: TFALQLHDPSGYLAE (PMEL_HUMAN)
  Core: FALQLHDPS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXALXLXDPXGYLAE

SEQ ID NO: 338465 - protein, 15 aa, Artificial Sequence
  Description of Artificial Sequence: Synthetic peptide
  Seed: TFALQLHDPSGYLAE (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAE

SEQ ID NO: 338466 - protein, 15 aa, Artificial Sequence
  Description of Artificial Sequence: Synthetic peptide
  Seed: TFALQLHDPSGYLAE (PMEL_HUMAN)
  Core: LHDPSGYLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TFALQXHDXSXYLXE

SEQ ID NO: 338467 - protein, 16 aa, Artificial Sequence
  Description of Artificial Sequence: Synthetic peptide
  Seed: TFALQLHDPSGYLAEA (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAEA

SEQ ID NO: 338468 - protein, 16 aa, Artificial Sequence
  Description of Artificial Sequence: Synthetic peptide
  Seed: TFALQLHDPSGYLAEA (PMEL_HUMAN)
  Core: LHDPSGYLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TFALQXHDXSXYLXEA

SEQ ID NO: 338469 - protein, 17 aa, Artificial Sequence
  Description of Artificial Sequence: Synthetic peptide
  Seed: TFALQLHDPSGYLAEAD (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAEAD

SEQ ID NO: 338470 - protein, 17 aa, Artificial Sequence
  Description of Artificial Sequence: Synthetic peptide
  Seed: TFALQLHDPSGYLAEAD (PMEL_HUMAN)
  Core: LHDPSGYLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TFALQXHDXSXYLXEAD

SEQ ID NO: 338471 - protein, 17 aa, Artificial Sequence
  Description of Artificial Sequence: Synthetic peptide
  Seed: TFALQLHDPSGYLAEAD (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAX

SEQ ID NO: 338472 - protein, 19 aa, Artificial Sequence
  Description of Artificial Sequence: Synthetic peptide
  Seed: TFALQLHDPSGYLAEADLS (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLS

SEQ ID NO: 338473 - protein, 20 aa, Artificial Sequence
  Description of Artificial Sequence: Synthetic peptide
  Seed: TFALQLHDPSGYLAEADLSY (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAEADLSY

SEQ ID NO: 338474 - protein, 20 aa, Artificial Sequence
  Description of Artificial Sequence: Synthetic peptide
  Seed: TFALQLHDPSGYLAEADLSY (PMEL_HUMAN)
  Core: LHDPSGYLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TFALQXHDXSXYLXEADLSY

SEQ ID NO: 338475 - protein, 20 aa, Artificial Sequence
  Description of Artificial Sequence: Synthetic peptide
  Seed: TFALQLHDPSGYLAEADLSY (PMEL_HUMAN)
  Core: HDPSGYLAE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLXDPXGXLAXADLSY

SEQ ID NO: 338476 - protein, 20 aa, Artificial Sequence
  Description of Artificial Sequence: Synthetic peptide
  Seed: TFALQLHDPSGYLAEADLSY (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSY

SEQ ID NO: 338477 - protein, 20 aa, Artificial Sequence
  Description of Artificial Sequence: Synthetic peptide
  Seed: TFALQLHDPSGYLAEADLSY (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSX

SEQ ID NO: 338478 - protein, 21 aa, Artificial Sequence
  Description of Artificial Sequence: Synthetic peptide
  Seed: TFALQLHDPSGYLAEADLSYT (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAEADLSYT

SEQ ID NO: 338479 - protein, 21 aa, Artificial Sequence
  Description of Artificial Sequence: Synthetic peptide
  Seed: TFALQLHDPSGYLAEADLSYT (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSYT

SEQ ID NO: 338480 - protein, 21 aa, Artificial Sequence
  Description of Artificial Sequence: Synthetic peptide
  Seed: TFALQLHDPSGYLAEADLSYT (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSXT

SEQ ID NO: 338481 - protein, 22 aa, Artificial Sequence
  Description of Artificial Sequence: Synthetic peptide
  Seed: TFALQLHDPSGYLAEADLSYTW (PMEL_HUMAN)
  Core: LQLHDPSGY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TFAXQLXDXSGXLAEADLSYTW

SEQ ID NO: 338482 - protein, 22 aa, Artificial Sequence
  Description of Artificial Sequence: Synthetic peptide
  Seed: TFALQLHDPSGYLAEADLSYTW (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSYTW

SEQ ID NO: 338483 - protein, 22 aa, Artificial Sequence
  Description of Artificial Sequence: Synthetic peptide
  Seed: TFALQLHDPSGYLAEADLSYTW (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSXTW

SEQ ID NO: 338484 - protein, 23 aa, Artificial Sequence
  Description of Artificial Sequence: Synthetic peptide
  Seed: TFALQLHDPSGYLAEADLSYTWD (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSYTWD

SEQ ID NO: 338485 - protein, 23 aa, Artificial Sequence
  Description of Artificial Sequence: Synthetic peptide
  Seed: TFALQLHDPSGYLAEADLSYTWD (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSXTWD

SEQ ID NO: 338486 - protein, 24 aa, Artificial Sequence
  Description of Artificial Sequence: Synthetic peptide
  Seed: TFALQLHDPSGYLAEADLSYTWDF (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSYTWDF

SEQ ID NO: 338487 - protein, 24 aa, Artificial Sequence
  Description of Artificial Sequence: Synthetic peptide
  Seed: TFALQLHDPSGYLAEADLSYTWDF (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSXTWDF

SEQ ID NO: 338488 - protein, 25 aa, Artificial Sequence
  Description of Artificial Sequence: Synthetic peptide
  Seed: TFALQLHDPSGYLAEADLSYTWDFG (PMEL_HUMAN)
  Core: PSGYLAEAD
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDXSGXLXEAXLSYTWDFG

SEQ ID NO: 338489 - protein, 25 aa, Artificial Sequence
  Description of Artificial Sequence: Synthetic peptide
  Seed: TFALQLHDPSGYLAEADLSYTWDFG (PMEL_HUMAN)
  Core: YLAEADLSY
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TFALQLHDPSGXLAXAXLSXTWDFG

SEQ ID NO: 338490 - protein, 13 aa, Artificial Sequence
  Description of Artificial Sequence: Synthetic peptide
  Seed: TGMTPAEVSIVVL (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVL

SEQ ID NO: 338491 - protein, 14 aa, Artificial Sequence
  Description of Artificial Sequence: Synthetic peptide
  Seed: TGMTPAEVSIVVLS (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLS

SEQ ID NO: 338492 - protein, 15 aa, Artificial Sequence
  Description of Artificial Sequence: Synthetic peptide
  Seed: TGMTPAEVSIVVLSG (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSG

SEQ ID NO: 338493 - protein, 16 aa, Artificial Sequence
  Description of Artificial Sequence: Synthetic peptide
  Seed: TGMTPAEVSIVVLSGT (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGT

SEQ ID NO: 338494 - protein, 16 aa, Artificial Sequence
  Description of Artificial Sequence: Synthetic peptide
  Seed: TGMTPAEVSIVVLSGT (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXT

SEQ ID NO: 338495 - protein, 17 aa, Artificial Sequence
  Description of Artificial Sequence: Synthetic peptide
  Seed: TGMTPAEVSIVVLSGTT (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGTT

SEQ ID NO: 338496 - protein, 17 aa, Artificial Sequence
  Description of Artificial Sequence: Synthetic peptide
  Seed: TGMTPAEVSIVVLSGTT (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTT

SEQ ID NO: 338497 - protein, 18 aa, Artificial Sequence
  Description of Artificial Sequence: Synthetic peptide
  Seed: TGMTPAEVSIVVLSGTTA (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGTTA

SEQ ID NO: 338498 - protein, 18 aa, Artificial Sequence
  Description of Artificial Sequence: Synthetic peptide
  Seed: TGMTPAEVSIVVLSGTTA (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTA

SEQ ID NO: 338499 - protein, 19 aa, Artificial Sequence
  Description of Artificial Sequence: Synthetic peptide
  Seed: TGMTPAEVSIVVLSGTTAA (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGTTAA

SEQ ID NO: 338500 - protein, 19 aa, Artificial Sequence
  Description of Artificial Sequence: Synthetic peptide
  Seed: TGMTPAEVSIVVLSGTTAA (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAA

SEQ ID NO: 338501 - protein, 19 aa, Artificial Sequence
  Description of Artificial Sequence: Synthetic peptide
  Seed: TGMTPAEVSIVVLSGTTAA (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXA

SEQ ID NO: 338502 - protein, 20 aa, Artificial Sequence
  Description of Artificial Sequence: Synthetic peptide
  Seed: TGMTPAEVSIVVLSGTTAAQ (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGTTAAQ

SEQ ID NO: 338503 - protein, 20 aa, Artificial Sequence
  Description of Artificial Sequence: Synthetic peptide
  Seed: TGMTPAEVSIVVLSGTTAAQ (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQ

SEQ ID NO: 338504 - protein, 20 aa, Artificial Sequence
  Description of Artificial Sequence: Synthetic peptide
  Seed: TGMTPAEVSIVVLSGTTAAQ (PMEL_HUMAN)
  Core: VSIVVLSGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEXSIXVXSGXTAAQ

SEQ ID NO: 338505 - protein, 20 aa, Artificial Sequence
  Description of Artificial Sequence: Synthetic peptide
  Seed: TGMTPAEVSIVVLSGTTAAQ (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQ

SEQ ID NO: 338506 - protein, 20 aa, Artificial Sequence
  Description of Artificial Sequence: Synthetic peptide
  Seed: TGMTPAEVSIVVLSGTTAAQ (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAX

SEQ ID NO: 338507 - protein, 21 aa, Artificial Sequence
  Description of Artificial Sequence: Synthetic peptide
  Seed: TGMTPAEVSIVVLSGTTAAQV (PMEL_HUMAN)
  Core: MTPAEVSIV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TGXTPXEXSIXVLSGTTAAQV

SEQ ID NO: 338508 - protein, 21 aa, Artificial Sequence
  Description of Artificial Sequence: Synthetic peptide
  Seed: TGMTPAEVSIVVLSGTTAAQV (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQV

SEQ ID NO: 338509 - protein, 21 aa, Artificial Sequence
  Description of Artificial Sequence: Synthetic peptide
  Seed: TGMTPAEVSIVVLSGTTAAQV (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQV

SEQ ID NO: 338510 - protein, 21 aa, Artificial Sequence
  Description of Artificial Sequence: Synthetic peptide
  Seed: TGMTPAEVSIVVLSGTTAAQV (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAXV

SEQ ID NO: 338511 - protein, 21 aa, Artificial Sequence
  Description of Artificial Sequence: Synthetic peptide
  Seed: TGMTPAEVSIVVLSGTTAAQV (PMEL_HUMAN)
  Core: LSGTTAAQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVVXSGXTXAQX

SEQ ID NO: 338512 - protein, 22 aa, Artificial Sequence
  Description of Artificial Sequence: Synthetic peptide
  Seed: TGMTPAEVSIVVLSGTTAAQVT (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQVT

SEQ ID NO: 338513 - protein, 22 aa, Artificial Sequence
  Description of Artificial Sequence: Synthetic peptide
  Seed: TGMTPAEVSIVVLSGTTAAQVT (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQVT

SEQ ID NO: 338514 - protein, 22 aa, Artificial Sequence
  Description of Artificial Sequence: Synthetic peptide
  Seed: TGMTPAEVSIVVLSGTTAAQVT (PMEL_HUMAN)
  Core: VVLSGTTAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIXVLXGXTAXQVT

SEQ ID NO: 338515 - protein, 22 aa, Artificial Sequence
  Description of Artificial Sequence: Synthetic peptide
  Seed: TGMTPAEVSIVVLSGTTAAQVT (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAXVT

SEQ ID NO: 338516 - protein, 22 aa, Artificial Sequence
  Description of Artificial Sequence: Synthetic peptide
  Seed: TGMTPAEVSIVVLSGTTAAQVT (PMEL_HUMAN)
  Core: LSGTTAAQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVVXSGXTXAQXT

SEQ ID NO: 338517 - protein, 23 aa, Artificial Sequence
  Description of Artificial Sequence: Synthetic peptide
  Seed: TGMTPAEVSIVVLSGTTAAQVTT (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQVTT

SEQ ID NO: 338518 - protein, 23 aa, Artificial Sequence
  Description of Artificial Sequence: Synthetic peptide
  Seed: TGMTPAEVSIVVLSGTTAAQVTT (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQVTT

SEQ ID NO: 338519 - protein, 23 aa, Artificial Sequence
  Description of Artificial Sequence: Synthetic peptide
  Seed: TGMTPAEVSIVVLSGTTAAQVTT (PMEL_HUMAN)
  Core: VVLSGTTAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIXVLXGXTAXQVTT

SEQ ID NO: 338520 - protein, 23 aa, Artificial Sequence
  Description of Artificial Sequence: Synthetic peptide
  Seed: TGMTPAEVSIVVLSGTTAAQVTT (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAXVTT

SEQ ID NO: 338521 - protein, 23 aa, Artificial Sequence
  Description of Artificial Sequence: Synthetic peptide
  Seed: TGMTPAEVSIVVLSGTTAAQVTT (PMEL_HUMAN)
  Core: LSGTTAAQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVVXSGXTXAQXTT

SEQ ID NO: 338522 - protein, 24 aa, Artificial Sequence
  Description of Artificial Sequence: Synthetic peptide
  Seed: TGMTPAEVSIVVLSGTTAAQVTTT (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQVTTT

SEQ ID NO: 338523 - protein, 24 aa, Artificial Sequence
  Description of Artificial Sequence: Synthetic peptide
  Seed: TGMTPAEVSIVVLSGTTAAQVTTT (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQVTTT

SEQ ID NO: 338524 - protein, 24 aa, Artificial Sequence
  Description of Artificial Sequence: Synthetic peptide
  Seed: TGMTPAEVSIVVLSGTTAAQVTTT (PMEL_HUMAN)
  Core: VVLSGTTAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIXVLXGXTAXQVTTT

SEQ ID NO: 338525 - protein, 24 aa, Artificial Sequence
  Description of Artificial Sequence: Synthetic peptide
  Seed: TGMTPAEVSIVVLSGTTAAQVTTT (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAXVTTT

SEQ ID NO: 338526 - protein, 24 aa, Artificial Sequence
  Description of Artificial Sequence: Synthetic peptide
  Seed: TGMTPAEVSIVVLSGTTAAQVTTT (PMEL_HUMAN)
  Core: LSGTTAAQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVVXSGXTXAQXTTT

SEQ ID NO: 338527 - protein, 25 aa, Artificial Sequence
  Description of Artificial Sequence: Synthetic peptide
  Seed: TGMTPAEVSIVVLSGTTAAQVTTTE (PMEL_HUMAN)
  Core: EVSIVVLSG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAXVSXVXLSXTTAAQVTTTE

SEQ ID NO: 338528 - protein, 25 aa, Artificial Sequence
  Description of Artificial Sequence: Synthetic peptide
  Seed: TGMTPAEVSIVVLSGTTAAQVTTTE (PMEL_HUMAN)
  Core: IVVLSGTTA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSXVVXSXTTXAQVTTTE

SEQ ID NO: 338529 - protein, 25 aa, Artificial Sequence
  Description of Artificial Sequence: Synthetic peptide
  Seed: TGMTPAEVSIVVLSGTTAAQVTTTE (PMEL_HUMAN)
  Core: VVLSGTTAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIXVLXGXTAXQVTTTE

SEQ ID NO: 338530 - protein, 25 aa, Artificial Sequence
  Description of Artificial Sequence: Synthetic peptide
  Seed: TGMTPAEVSIVVLSGTTAAQVTTTE (PMEL_HUMAN)
  Core: VLSGTTAAQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVXLSXTXAAXVTTTE

SEQ ID NO: 338531 - protein, 25 aa, Artificial Sequence
  Description of Artificial Sequence: Synthetic peptide
  Seed: TGMTPAEVSIVVLSGTTAAQVTTTE (PMEL_HUMAN)
  Core: LSGTTAAQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPAEVSIVVXSGXTXAQXTTTE

SEQ ID NO: 338532 - protein, 20 aa, Artificial Sequence
  Description of Artificial Sequence: Synthetic peptide
  Seed: TGMTPEKVPVSEVMGTTLAE (PMEL_HUMAN)
  Core: VPVSEVMGT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKXPVXEXMGXTLAE

SEQ ID NO: 338533 - protein, 21 aa, Artificial Sequence
  Description of Artificial Sequence: Synthetic peptide
  Seed: TGMTPEKVPVSEVMGTTLAEM (PMEL_HUMAN)
  Core: VSEVMGTTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPXSEXMXTTXAEM

SEQ ID NO: 338534 - protein, 21 aa, Artificial Sequence
  Description of Artificial Sequence: Synthetic peptide
  Seed: TGMTPEKVPVSEVMGTTLAEM (PMEL_HUMAN)
  Core: VMGTTLAEM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEXMGXTXAEX

SEQ ID NO: 338535 - protein, 22 aa, Artificial Sequence
  Description of Artificial Sequence: Synthetic peptide
  Seed: TGMTPEKVPVSEVMGTTLAEMS (PMEL_HUMAN)
  Core: VSEVMGTTL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPXSEXMXTTXAEMS

SEQ ID NO: 338536 - protein, 22 aa, Artificial Sequence
  Description of Artificial Sequence: Synthetic peptide
  Seed: TGMTPEKVPVSEVMGTTLAEMS (PMEL_HUMAN)
  Core: VMGTTLAEM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEXMGXTXAEXS

SEQ ID NO: 338537 - protein, 23 aa, Artificial Sequence
  Description of Artificial Sequence: Synthetic peptide
  Seed: TGMTPEKVPVSEVMGTTLAEMST (PMEL_HUMAN)
  Core: VMGTTLAEM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEXMGXTXAEXST

SEQ ID NO: 338538 - protein, 23 aa, Artificial Sequence
  Description of Artificial Sequence: Synthetic peptide
  Seed: TGMTPEKVPVSEVMGTTLAEMST (PMEL_HUMAN)
  Core: MGTTLAEMS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEVXGTXLXEMXT

SEQ ID NO: 338539 - protein, 24 aa, Artificial Sequence
  Description of Artificial Sequence: Synthetic peptide
  Seed: TGMTPEKVPVSEVMGTTLAEMSTP (PMEL_HUMAN)
  Core: VMGTTLAEM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEXMGXTXAEXSTP

SEQ ID NO: 338540 - protein, 24 aa, Artificial Sequence
  Description of Artificial Sequence: Synthetic peptide
  Seed: TGMTPEKVPVSEVMGTTLAEMSTP (PMEL_HUMAN)
  Core: MGTTLAEMS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEVXGTXLXEMXTP

SEQ ID NO: 338541 - protein, 25 aa, Artificial Sequence
  Description of Artificial Sequence: Synthetic peptide
  Seed: TGMTPEKVPVSEVMGTTLAEMSTPE (PMEL_HUMAN)
  Core: VMGTTLAEM
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEXMGXTXAEXSTPE

SEQ ID NO: 338542 - protein, 25 aa, Artificial Sequence
  Description of Artificial Sequence: Synthetic peptide
  Seed: TGMTPEKVPVSEVMGTTLAEMSTPE (PMEL_HUMAN)
  Core: MGTTLAEMS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGMTPEKVPVSEVXGTXLXEMXTPE

SEQ ID NO: 338543 - protein, 14 aa, Artificial Sequence
  Description of Artificial Sequence: Synthetic peptide
  Seed: TGRAMLGTHTMEVT (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXT

SEQ ID NO: 338544 - protein, 15 aa, Artificial Sequence
  Description of Artificial Sequence: Synthetic peptide
  Seed: TGRAMLGTHTMEVTV (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTV

SEQ ID NO: 338545 - protein, 16 aa, Artificial Sequence
  Description of Artificial Sequence: Synthetic peptide
  Seed: TGRAMLGTHTMEVTVY (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVY

SEQ ID NO: 338546 - protein, 17 aa, Artificial Sequence
  Description of Artificial Sequence: Synthetic peptide
  Seed: TGRAMLGTHTMEVTVYH (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYH

SEQ ID NO: 338547 - protein, 17 aa, Artificial Sequence
  Description of Artificial Sequence: Synthetic peptide
  Seed: TGRAMLGTHTMEVTVYH (PMEL_HUMAN)
  Core: LGTHTMEVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMXGTXTXEVXVYH

SEQ ID NO: 338548 - protein, 17 aa, Artificial Sequence
  Description of Artificial Sequence: Synthetic peptide
  Seed: TGRAMLGTHTMEVTVYH (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXH

SEQ ID NO: 338549 - protein, 18 aa, Artificial Sequence
  Description of Artificial Sequence: Synthetic peptide
  Seed: TGRAMLGTHTMEVTVYHR (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHR

SEQ ID NO: 338550 - protein, 18 aa, Artificial Sequence
  Description of Artificial Sequence: Synthetic peptide
  Seed: TGRAMLGTHTMEVTVYHR (PMEL_HUMAN)
  Core: LGTHTMEVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMXGTXTXEVXVYHR

SEQ ID NO: 338551 - protein, 19 aa, Artificial Sequence
  Description of Artificial Sequence: Synthetic peptide
  Seed: TGRAMLGTHTMEVTVYHRR (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRR

SEQ ID NO: 338552 - protein, 19 aa, Artificial Sequence
  Description of Artificial Sequence: Synthetic peptide
  Seed: TGRAMLGTHTMEVTVYHRR (PMEL_HUMAN)
  Core: LGTHTMEVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMXGTXTXEVXVYHRR

SEQ ID NO: 338553 - protein, 19 aa, Artificial Sequence
  Description of Artificial Sequence: Synthetic peptide
  Seed: TGRAMLGTHTMEVTVYHRR (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRR

SEQ ID NO: 338554 - protein, 20 aa, Artificial Sequence
  Description of Artificial Sequence: Synthetic peptide
  Seed: TGRAMLGTHTMEVTVYHRRG (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRG

SEQ ID NO: 338555 - protein, 20 aa, Artificial Sequence
  Description of Artificial Sequence: Synthetic peptide
  Seed: TGRAMLGTHTMEVTVYHRRG (PMEL_HUMAN)
  Core: LGTHTMEVT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMXGTXTXEVXVYHRRG

SEQ ID NO: 338556 - protein, 20 aa, Artificial Sequence
  Description of Artificial Sequence: Synthetic peptide
  Seed: TGRAMLGTHTMEVTVYHRRG (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRG

SEQ ID NO: 338557 - protein, 20 aa, Artificial Sequence
  Description of Artificial Sequence: Synthetic peptide
  Seed: TGRAMLGTHTMEVTVYHRRG (PMEL_HUMAN)
  Core: HTMEVTVYH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTXTMXVXVYXRRG

SEQ ID NO: 338558 - protein, 20 aa, Artificial Sequence
  Description of Artificial Sequence: Synthetic peptide
  Seed: TGRAMLGTHTMEVTVYHRRG (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXG

SEQ ID NO: 338559 - protein, 21 aa, Artificial Sequence
  Description of Artificial Sequence: Synthetic peptide
  Seed: TGRAMLGTHTMEVTVYHRRGS (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRGS

SEQ ID NO: 338560 - protein, 21 aa, Artificial Sequence
  Description of Artificial Sequence: Synthetic peptide
  Seed: TGRAMLGTHTMEVTVYHRRGS (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRGS

SEQ ID NO: 338561 - protein, 21 aa, Artificial Sequence
  Description of Artificial Sequence: Synthetic peptide
  Seed: TGRAMLGTHTMEVTVYHRRGS (PMEL_HUMAN)
  Core: HTMEVTVYH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTXTMXVXVYXRRGS

SEQ ID NO: 338562 - protein, 21 aa, Artificial Sequence
  Description of Artificial Sequence: Synthetic peptide
  Seed: TGRAMLGTHTMEVTVYHRRGS (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXGS

SEQ ID NO: 338563 - protein, 21 aa, Artificial Sequence
  Description of Artificial Sequence: Synthetic peptide
  Seed: TGRAMLGTHTMEVTVYHRRGS (PMEL_HUMAN)
  Core: VTVYHRRGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTMEXTVXHXRGX

SEQ ID NO: 338564 - protein, 22 aa, Artificial Sequence
  Description of Artificial Sequence: Synthetic peptide
  Seed: TGRAMLGTHTMEVTVYHRRGSR (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRGSR

SEQ ID NO: 338565 - protein, 22 aa, Artificial Sequence
  Description of Artificial Sequence: Synthetic peptide
  Seed: TGRAMLGTHTMEVTVYHRRGSR (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRGSR

SEQ ID NO: 338566 - protein, 22 aa, Artificial Sequence
  Description of Artificial Sequence: Synthetic peptide
  Seed: TGRAMLGTHTMEVTVYHRRGSR (PMEL_HUMAN)
  Core: HTMEVTVYH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTXTMXVXVYXRRGSR

SEQ ID NO: 338567 - protein, 22 aa, Artificial Sequence
  Description of Artificial Sequence: Synthetic peptide
  Seed: TGRAMLGTHTMEVTVYHRRGSR (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXGSR

SEQ ID NO: 338568 - protein, 22 aa, Artificial Sequence
  Description of Artificial Sequence: Synthetic peptide
  Seed: TGRAMLGTHTMEVTVYHRRGSR (PMEL_HUMAN)
  Core: VTVYHRRGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTMEXTVXHXRGXR

SEQ ID NO: 338569 - protein, 23 aa, Artificial Sequence
  Description of Artificial Sequence: Synthetic peptide
  Seed: TGRAMLGTHTMEVTVYHRRGSRS (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRGSRS

SEQ ID NO: 338570 - protein, 23 aa, Artificial Sequence
  Description of Artificial Sequence: Synthetic peptide
  Seed: TGRAMLGTHTMEVTVYHRRGSRS (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRGSRS

SEQ ID NO: 338571 - protein, 23 aa, Artificial Sequence
  Description of Artificial Sequence: Synthetic peptide
  Seed: TGRAMLGTHTMEVTVYHRRGSRS (PMEL_HUMAN)
  Core: HTMEVTVYH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTXTMXVXVYXRRGSRS

SEQ ID NO: 338572 - protein, 23 aa, Artificial Sequence
  Description of Artificial Sequence: Synthetic peptide
  Seed: TGRAMLGTHTMEVTVYHRRGSRS (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXGSRS

SEQ ID NO: 338573 - protein, 23 aa, Artificial Sequence
  Description of Artificial Sequence: Synthetic peptide
  Seed: TGRAMLGTHTMEVTVYHRRGSRS (PMEL_HUMAN)
  Core: VTVYHRRGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTMEXTVXHXRGXRS

SEQ ID NO: 338574 - protein, 24 aa, Artificial Sequence
  Description of Artificial Sequence: Synthetic peptide
  Seed: TGRAMLGTHTMEVTVYHRRGSRSY (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRGSRSY

SEQ ID NO: 338575 - protein, 24 aa, Artificial Sequence
  Description of Artificial Sequence: Synthetic peptide
  Seed: TGRAMLGTHTMEVTVYHRRGSRSY (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRGSRSY

SEQ ID NO: 338576 - protein, 24 aa, Artificial Sequence
  Description of Artificial Sequence: Synthetic peptide
  Seed: TGRAMLGTHTMEVTVYHRRGSRSY (PMEL_HUMAN)
  Core: HTMEVTVYH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTXTMXVXVYXRRGSRSY

SEQ ID NO: 338577 - protein, 24 aa, Artificial Sequence
  Description of Artificial Sequence: Synthetic peptide
  Seed: TGRAMLGTHTMEVTVYHRRGSRSY (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXGSRSY

SEQ ID NO: 338578 - protein, 24 aa, Artificial Sequence
  Description of Artificial Sequence: Synthetic peptide
  Seed: TGRAMLGTHTMEVTVYHRRGSRSY (PMEL_HUMAN)
  Core: VTVYHRRGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTMEXTVXHXRGXRSY

SEQ ID NO: 338579 - protein, 25 aa, Artificial Sequence
  Description of Artificial Sequence: Synthetic peptide
  Seed: TGRAMLGTHTMEVTVYHRRGSRSYV (PMEL_HUMAN)
  Core: MLGTHTMEV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TGRAXLGXHXMEXTVYHRRGSRSYV

SEQ ID NO: 338580 - protein, 25 aa, Artificial Sequence
  Description of Artificial Sequence: Synthetic peptide
  Seed: TGRAMLGTHTMEVTVYHRRGSRSYV (PMEL_HUMAN)
  Core: THTMEVTVY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGXHTXEXTVXHRRGSRSYV

SEQ ID NO: 338581 - protein, 25 aa, Artificial Sequence
  Description of Artificial Sequence: Synthetic peptide
  Seed: TGRAMLGTHTMEVTVYHRRGSRSYV (PMEL_HUMAN)
  Core: MEVTVYHRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTXEVXVXHRXGSRSYV

SEQ ID NO: 338582 - protein, 25 aa, Artificial Sequence
  Description of Artificial Sequence: Synthetic peptide
  Seed: TGRAMLGTHTMEVTVYHRRGSRSYV (PMEL_HUMAN)
  Core: VTVYHRRGS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGRAMLGTHTMEXTVXHXRGXRSYV

SEQ ID NO: 338583 - protein, 16 aa, Artificial Sequence
  Description of Artificial Sequence: Synthetic peptide
  Seed: TGSLGPLLDGTATLRL (PMEL_HUMAN)
  Core: LGPLLDGTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TGSXGPXLXGTXTLRL

SEQ ID NO: 338584 - protein, 16 aa, Artificial Sequence
  Description of Artificial Sequence: Synthetic peptide
  Seed: TGSLGPLLDGTATLRL (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRX

SEQ ID NO: 338585 - protein, 17 aa, Artificial Sequence
  Description of Artificial Sequence: Synthetic peptide
  Seed: TGSLGPLLDGTATLRLV (PMEL_HUMAN)
  Core: LGPLLDGTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TGSXGPXLXGTXTLRLV

SEQ ID NO: 338586 - protein, 17 aa, Artificial Sequence
  Description of Artificial Sequence: Synthetic peptide
  Seed: TGSLGPLLDGTATLRLV (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXV

SEQ ID NO: 338587 - protein, 19 aa, Artificial Sequence
  Description of Artificial Sequence: Synthetic peptide
  Seed: TGSLGPLLDGTATLRLVKR (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKR

SEQ ID NO: 338588 - protein, 20 aa, Artificial Sequence
  Description of Artificial Sequence: Synthetic peptide
  Seed: TGSLGPLLDGTATLRLVKRQ (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQ

SEQ ID NO: 338589 - protein, 20 aa, Artificial Sequence
  Description of Artificial Sequence: Synthetic peptide
  Seed: TGSLGPLLDGTATLRLVKRQ (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQ

SEQ ID NO: 338590 - protein, 21 aa, Artificial Sequence
  Description of Artificial Sequence: Synthetic peptide
  Seed: TGSLGPLLDGTATLRLVKRQV (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQV

SEQ ID NO: 338591 - protein, 21 aa, Artificial Sequence
  Description of Artificial Sequence: Synthetic peptide
  Seed: TGSLGPLLDGTATLRLVKRQV (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQV

SEQ ID NO: 338592 - protein, 22 aa, Artificial Sequence
  Description of Artificial Sequence: Synthetic peptide
  Seed: TGSLGPLLDGTATLRLVKRQVP (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQVP

SEQ ID NO: 338593 - protein, 22 aa, Artificial Sequence
  Description of Artificial Sequence: Synthetic peptide
  Seed: TGSLGPLLDGTATLRLVKRQVP (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQVP

SEQ ID NO: 338594 - protein, 22 aa, Artificial Sequence
  Description of Artificial Sequence: Synthetic peptide
  Seed: TGSLGPLLDGTATLRLVKRQVP (PMEL_HUMAN)
  Core: LRLVKRQVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTATXRLXKXQVX

SEQ ID NO: 338595 - protein, 23 aa, Artificial Sequence
  Description of Artificial Sequence: Synthetic peptide
  Seed: TGSLGPLLDGTATLRLVKRQVPL (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQVPL

SEQ ID NO: 338596 - protein, 23 aa, Artificial Sequence
  Description of Artificial Sequence: Synthetic peptide
  Seed: TGSLGPLLDGTATLRLVKRQVPL (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQVPL

SEQ ID NO: 338597 - protein, 23 aa, Artificial Sequence
  Description of Artificial Sequence: Synthetic peptide
  Seed: TGSLGPLLDGTATLRLVKRQVPL (PMEL_HUMAN)
  Core: LRLVKRQVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTATXRLXKXQVXL

SEQ ID NO: 338598 - protein, 24 aa, Artificial Sequence
  Description of Artificial Sequence: Synthetic peptide
  Seed: TGSLGPLLDGTATLRLVKRQVPLD (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQVPLD

SEQ ID NO: 338599 - protein, 24 aa, Artificial Sequence
  Description of Artificial Sequence: Synthetic peptide
  Seed: TGSLGPLLDGTATLRLVKRQVPLD (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQVPLD

SEQ ID NO: 338600 - protein, 24 aa, Artificial Sequence
  Description of Artificial Sequence: Synthetic peptide
  Seed: TGSLGPLLDGTATLRLVKRQVPLD (PMEL_HUMAN)
  Core: TLRLVKRQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTAXLRXVXRQXPLD

SEQ ID NO: 338601 - protein, 24 aa, Artificial Sequence
  Description of Artificial Sequence: Synthetic peptide
  Seed: TGSLGPLLDGTATLRLVKRQVPLD (PMEL_HUMAN)
  Core: LRLVKRQVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTATXRLXKXQVXLD

SEQ ID NO: 338602 - protein, 25 aa, Artificial Sequence
  Description of Artificial Sequence: Synthetic peptide
  Seed: TGSLGPLLDGTATLRLVKRQVPLDC (PMEL_HUMAN)
  Core: LDGTATLRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLXDGXAXLRXVKRQVPLDC

SEQ ID NO: 338603 - protein, 25 aa, Artificial Sequence
  Description of Artificial Sequence: Synthetic peptide
  Seed: TGSLGPLLDGTATLRLVKRQVPLDC (PMEL_HUMAN)
  Core: DGTATLRLV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLXGTXTXRLXKRQVPLDC

SEQ ID NO: 338604 - protein, 25 aa, Artificial Sequence
  Description of Artificial Sequence: Synthetic peptide
  Seed: TGSLGPLLDGTATLRLVKRQVPLDC (PMEL_HUMAN)
  Core: TLRLVKRQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTAXLRXVXRQXPLDC

SEQ ID NO: 338605 - protein, 25 aa, Artificial Sequence
  Description of Artificial Sequence: Synthetic peptide
  Seed: TGSLGPLLDGTATLRLVKRQVPLDC (PMEL_HUMAN)
  Core: LRLVKRQVP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TGSLGPLLDGTATXRLXKXQVXLDC

SEQ ID NO: 338606 - protein, 14 aa, Artificial Sequence
  Description of Artificial Sequence: Synthetic peptide
  Seed: THTMEVTVYHRRGS (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGX

SEQ ID NO: 338607 - protein, 15 aa, Artificial Sequence
  Description of Artificial Sequence: Synthetic peptide
  Seed: THTMEVTVYHRRGSR (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXR

SEQ ID NO: 338608 - protein, 16 aa, Artificial Sequence
  Description of Artificial Sequence: Synthetic peptide
  Seed: THTMEVTVYHRRGSRS (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRS

SEQ ID NO: 338609 - protein, 17 aa, Artificial Sequence
  Description of Artificial Sequence: Synthetic peptide
  Seed: THTMEVTVYHRRGSRSY (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSY

SEQ ID NO: 338610 - protein, 18 aa, Artificial Sequence
  Description of Artificial Sequence: Synthetic peptide
  Seed: THTMEVTVYHRRGSRSYV (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYV

SEQ ID NO: 338611 - protein, 19 aa, Artificial Sequence
  Description of Artificial Sequence: Synthetic peptide
  Seed: THTMEVTVYHRRGSRSYVP (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVP

SEQ ID NO: 338612 - protein, 20 aa, Artificial Sequence
  Description of Artificial Sequence: Synthetic peptide
  Seed: THTMEVTVYHRRGSRSYVPL (PMEL_HUMAN)
  Core: MEVTVYHRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXEVXVXHRXGSRSYVPL

SEQ ID NO: 338613 - protein, 20 aa, Artificial Sequence
  Description of Artificial Sequence: Synthetic peptide
  Seed: THTMEVTVYHRRGSRSYVPL (PMEL_HUMAN)
  Core: EVTVYHRRG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
THTMXVTXYXRRXSRSYVPL

SEQ ID NO: 338614 - protein, 20 aa, Artificial Sequence
  Description of Artificial Sequence: Synthetic peptide
  Seed: THTMEVTVYHRRGSRSYVPL (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPL

SEQ ID NO: 338615 - protein, 20 aa, Artificial Sequence
  Description of Artificial Sequence: Synthetic peptide
  Seed: THTMEVTVYHRRGSRSYVPL (PMEL_HUMAN)
  Core: YHRRGSRSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVXHRXGXRSXVPL

SEQ ID NO: 338616 - protein, 21 aa, Artificial Sequence
  Description of Artificial Sequence: Synthetic peptide
  Seed: THTMEVTVYHRRGSRSYVPLA (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPLA

SEQ ID NO: 338617 - protein, 22 aa, Artificial Sequence
  Description of Artificial Sequence: Synthetic peptide
  Seed: THTMEVTVYHRRGSRSYVPLAH (PMEL_HUMAN)
  Core: MEVTVYHRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXEVXVXHRXGSRSYVPLAH

SEQ ID NO: 338618 - protein, 22 aa, Artificial Sequence
  Description of Artificial Sequence: Synthetic peptide
  Seed: THTMEVTVYHRRGSRSYVPLAH (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPLAH

SEQ ID NO: 338619 - protein, 22 aa, Artificial Sequence
  Description of Artificial Sequence: Synthetic peptide
  Seed: THTMEVTVYHRRGSRSYVPLAH (PMEL_HUMAN)
  Core: YHRRGSRSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVXHRXGXRSXVPLAH

SEQ ID NO: 338620 - protein, 22 aa, Artificial Sequence
  Description of Artificial Sequence: Synthetic peptide
  Seed: THTMEVTVYHRRGSRSYVPLAH (PMEL_HUMAN)
  Core: RRGSRSYVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHXRGXRXYVXLAH

SEQ ID NO: 338621 - protein, 23 aa, Artificial Sequence
  Description of Artificial Sequence: Synthetic peptide
  Seed: THTMEVTVYHRRGSRSYVPLAHS (PMEL_HUMAN)
  Core: MEVTVYHRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXEVXVXHRXGSRSYVPLAHS

SEQ ID NO: 338622 - protein, 23 aa, Artificial Sequence
  Description of Artificial Sequence: Synthetic peptide
  Seed: THTMEVTVYHRRGSRSYVPLAHS (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPLAHS

SEQ ID NO: 338623 - protein, 23 aa, Artificial Sequence
  Description of Artificial Sequence: Synthetic peptide
  Seed: THTMEVTVYHRRGSRSYVPLAHS (PMEL_HUMAN)
  Core: YHRRGSRSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVXHRXGXRSXVPLAHS

SEQ ID NO: 338624 - protein, 23 aa, Artificial Sequence
  Description of Artificial Sequence: Synthetic peptide
  Seed: THTMEVTVYHRRGSRSYVPLAHS (PMEL_HUMAN)
  Core: GSRSYVPLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRXSRXYXPLXHS

SEQ ID NO: 338625 - protein, 23 aa, Artificial Sequence
  Description of Artificial Sequence: Synthetic peptide
  Seed: THTMEVTVYHRRGSRSYVPLAHS (PMEL_HUMAN)
  Core: SRSYVPLAH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGXRSXVXLAXS

SEQ ID NO: 338626 - protein, 23 aa, Artificial Sequence
  Description of Artificial Sequence: Synthetic peptide
  Seed: THTMEVTVYHRRGSRSYVPLAHS (PMEL_HUMAN)
  Core: RSYVPLAHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGSXSYXPXAHX

SEQ ID NO: 338627 - protein, 24 aa, Artificial Sequence
  Description of Artificial Sequence: Synthetic peptide
  Seed: THTMEVTVYHRRGSRSYVPLAHSS (PMEL_HUMAN)
  Core: MEVTVYHRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXEVXVXHRXGSRSYVPLAHSS

SEQ ID NO: 338628 - protein, 24 aa, Artificial Sequence
  Description of Artificial Sequence: Synthetic peptide
  Seed: THTMEVTVYHRRGSRSYVPLAHSS (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPLAHSS

SEQ ID NO: 338629 - protein, 24 aa, Artificial Sequence
  Description of Artificial Sequence: Synthetic peptide
  Seed: THTMEVTVYHRRGSRSYVPLAHSS (PMEL_HUMAN)
  Core: YHRRGSRSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVXHRXGXRSXVPLAHSS

SEQ ID NO: 338630 - protein, 24 aa, Artificial Sequence
  Description of Artificial Sequence: Synthetic peptide
  Seed: THTMEVTVYHRRGSRSYVPLAHSS (PMEL_HUMAN)
  Core: GSRSYVPLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRXSRXYXPLXHSS

SEQ ID NO: 338631 - protein, 24 aa, Artificial Sequence
  Description of Artificial Sequence: Synthetic peptide
  Seed: THTMEVTVYHRRGSRSYVPLAHSS (PMEL_HUMAN)
  Core: SRSYVPLAH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGXRSXVXLAXSS

SEQ ID NO: 338632 - protein, 24 aa, Artificial Sequence
  Description of Artificial Sequence: Synthetic peptide
  Seed: THTMEVTVYHRRGSRSYVPLAHSS (PMEL_HUMAN)
  Core: RSYVPLAHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGSXSYXPXAHXS

SEQ ID NO: 338633 - protein, 25 aa, Artificial Sequence
  Description of Artificial Sequence: Synthetic peptide
  Seed: THTMEVTVYHRRGSRSYVPLAHSSS (PMEL_HUMAN)
  Core: MEVTVYHRR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXEVXVXHRXGSRSYVPLAHSSS

SEQ ID NO: 338634 - protein, 25 aa, Artificial Sequence
  Description of Artificial Sequence: Synthetic peptide
  Seed: THTMEVTVYHRRGSRSYVPLAHSSS (PMEL_HUMAN)
  Core: VTVYHRRGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
THTMEXTVXHXRGXRSYVPLAHSSS

SEQ ID NO: 338635 - protein, 25 aa, Artificial Sequence
  Description of Artificial Sequence: Synthetic peptide
  Seed: THTMEVTVYHRRGSRSYVPLAHSSS (PMEL_HUMAN)
  Core: YHRRGSRSY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVXHRXGXRSXVPLAHSSS

SEQ ID NO: 338636 - protein, 25 aa, Artificial Sequence
  Description of Artificial Sequence: Synthetic peptide
  Seed: THTMEVTVYHRRGSRSYVPLAHSSS (PMEL_HUMAN)
  Core: GSRSYVPLA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRXSRXYXPLXHSSS

SEQ ID NO: 338637 - protein, 25 aa, Artificial Sequence
  Description of Artificial Sequence: Synthetic peptide
  Seed: THTMEVTVYHRRGSRSYVPLAHSSS (PMEL_HUMAN)
  Core: SRSYVPLAH
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGXRSXVXLAXSSS

SEQ ID NO: 338638 - protein, 25 aa, Artificial Sequence
  Description of Artificial Sequence: Synthetic peptide
  Seed: THTMEVTVYHRRGSRSYVPLAHSSS (PMEL_HUMAN)
  Core: RSYVPLAHS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGSXSYXPXAHXSS

SEQ ID NO: 338639 - protein, 25 aa, Artificial Sequence
  Description of Artificial Sequence: Synthetic peptide
  Seed: THTMEVTVYHRRGSRSYVPLAHSSS (PMEL_HUMAN)
  Core: YVPLAHSSS
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
THTMEVTVYHRRGSRSXVPXAXSSX

SEQ ID NO: 338640 - protein, 14 aa, Artificial Sequence
  Description of Artificial Sequence: Synthetic peptide
  Seed: THTYLEPGPVTAQV (PMEL_HUMAN)
  Core: LEPGPVTAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
THTYXEPXPXTAXV

SEQ ID NO: 338641 - protein, 15 aa, Artificial Sequence
  Description of Artificial Sequence: Synthetic peptide
  Seed: THTYLEPGPVTAQVV (PMEL_HUMAN)
  Core: YLEPGPVTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
THTXLEXGXVTXQVV

SEQ ID NO: 338642 - protein, 15 aa, Artificial Sequence
  Description of Artificial Sequence: Synthetic peptide
  Seed: THTYLEPGPVTAQVV (PMEL_HUMAN)
  Core: LEPGPVTAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
THTYXEPXPXTAXVV

SEQ ID NO: 338643 - protein, 15 aa, Artificial Sequence
  Description of Artificial Sequence: Synthetic peptide
  Seed: THTYLEPGPVTAQVV (PMEL_HUMAN)
  Core: PGPVTAQVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEXGPXTXQVX

SEQ ID NO: 338644 - protein, 16 aa, Artificial Sequence
  Description of Artificial Sequence: Synthetic peptide
  Seed: THTYLEPGPVTAQVVL (PMEL_HUMAN)
  Core: LEPGPVTAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
THTYXEPXPXTAXVVL

SEQ ID NO: 338645 - protein, 16 aa, Artificial Sequence
  Description of Artificial Sequence: Synthetic peptide
  Seed: THTYLEPGPVTAQVVL (PMEL_HUMAN)
  Core: PGPVTAQVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEXGPXTXQVXL

SEQ ID NO: 338646 - protein, 17 aa, Artificial Sequence
  Description of Artificial Sequence: Synthetic peptide
  Seed: THTYLEPGPVTAQVVLQ (PMEL_HUMAN)
  Core: LEPGPVTAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
THTYXEPXPXTAXVVLQ

SEQ ID NO: 338647 - protein, 17 aa, Artificial Sequence
  Description of Artificial Sequence: Synthetic peptide
  Seed: THTYLEPGPVTAQVVLQ (PMEL_HUMAN)
  Core: PGPVTAQVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEXGPXTXQVXLQ

SEQ ID NO: 338648 - protein, 17 aa, Artificial Sequence
  Description of Artificial Sequence: Synthetic peptide
  Seed: THTYLEPGPVTAQVVLQ (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLX

SEQ ID NO: 338649 - protein, 18 aa, Artificial Sequence
  Description of Artificial Sequence: Synthetic peptide
  Seed: THTYLEPGPVTAQVVLQA (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXA

SEQ ID NO: 338650 - protein, 19 aa, Artificial Sequence
  Description of Artificial Sequence: Synthetic peptide
  Seed: THTYLEPGPVTAQVVLQAA (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAA

SEQ ID NO: 338651 - protein, 19 aa, Artificial Sequence
  Description of Artificial Sequence: Synthetic peptide
  Seed: THTYLEPGPVTAQVVLQAA (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXA

SEQ ID NO: 338652 - protein, 20 aa, Artificial Sequence
  Description of Artificial Sequence: Synthetic peptide
  Seed: THTYLEPGPVTAQVVLQAAI (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAI

SEQ ID NO: 338653 - protein, 20 aa, Artificial Sequence
  Description of Artificial Sequence: Synthetic peptide
  Seed: THTYLEPGPVTAQVVLQAAI (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAI

SEQ ID NO: 338654 - protein, 20 aa, Artificial Sequence
  Description of Artificial Sequence: Synthetic peptide
  Seed: THTYLEPGPVTAQVVLQAAI (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXI

SEQ ID NO: 338655 - protein, 21 aa, Artificial Sequence
  Description of Artificial Sequence: Synthetic peptide
  Seed: THTYLEPGPVTAQVVLQAAIP (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAIP

SEQ ID NO: 338656 - protein, 21 aa, Artificial Sequence
  Description of Artificial Sequence: Synthetic peptide
  Seed: THTYLEPGPVTAQVVLQAAIP (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAIP

SEQ ID NO: 338657 - protein, 21 aa, Artificial Sequence
  Description of Artificial Sequence: Synthetic peptide
  Seed: THTYLEPGPVTAQVVLQAAIP (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXIP

SEQ ID NO: 338658 - protein, 22 aa, Artificial Sequence
  Description of Artificial Sequence: Synthetic peptide
  Seed: THTYLEPGPVTAQVVLQAAIPL (PMEL_HUMAN)
  Core: PGPVTAQVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEXGPXTXQVXLQAAIPL

SEQ ID NO: 338659 - protein, 22 aa, Artificial Sequence
  Description of Artificial Sequence: Synthetic peptide
  Seed: THTYLEPGPVTAQVVLQAAIPL (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAIPL

SEQ ID NO: 338660 - protein, 22 aa, Artificial Sequence
  Description of Artificial Sequence: Synthetic peptide
  Seed: THTYLEPGPVTAQVVLQAAIPL (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAIPL

SEQ ID NO: 338661 - protein, 22 aa, Artificial Sequence
  Description of Artificial Sequence: Synthetic peptide
  Seed: THTYLEPGPVTAQVVLQAAIPL (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXIPL

SEQ ID NO: 338662 - protein, 23 aa, Artificial Sequence
  Description of Artificial Sequence: Synthetic peptide
  Seed: THTYLEPGPVTAQVVLQAAIPLT (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAIPLT

SEQ ID NO: 338663 - protein, 23 aa, Artificial Sequence
  Description of Artificial Sequence: Synthetic peptide
  Seed: THTYLEPGPVTAQVVLQAAIPLT (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAIPLT

SEQ ID NO: 338664 - protein, 23 aa, Artificial Sequence
  Description of Artificial Sequence: Synthetic peptide
  Seed: THTYLEPGPVTAQVVLQAAIPLT (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXIPLT

SEQ ID NO: 338665 - protein, 23 aa, Artificial Sequence
  Description of Artificial Sequence: Synthetic peptide
  Seed: THTYLEPGPVTAQVVLQAAIPLT (PMEL_HUMAN)
  Core: VVLQAAIPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVTAQXVLXAXIPXT

SEQ ID NO: 338666 - protein, 24 aa, Artificial Sequence
  Description of Artificial Sequence: Synthetic peptide
  Seed: THTYLEPGPVTAQVVLQAAIPLTS (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAIPLTS

SEQ ID NO: 338667 - protein, 24 aa, Artificial Sequence
  Description of Artificial Sequence: Synthetic peptide
  Seed: THTYLEPGPVTAQVVLQAAIPLTS (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAIPLTS

SEQ ID NO: 338668 - protein, 24 aa, Artificial Sequence
  Description of Artificial Sequence: Synthetic peptide
  Seed: THTYLEPGPVTAQVVLQAAIPLTS (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXIPLTS

SEQ ID NO: 338669 - protein, 24 aa, Artificial Sequence
  Description of Artificial Sequence: Synthetic peptide
  Seed: THTYLEPGPVTAQVVLQAAIPLTS (PMEL_HUMAN)
  Core: VVLQAAIPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVTAQXVLXAXIPXTS

SEQ ID NO: 338670 - protein, 25 aa, Artificial Sequence
  Description of Artificial Sequence: Synthetic peptide
  Seed: THTYLEPGPVTAQVVLQAAIPLTSC (PMEL_HUMAN)
  Core: PVTAQVVLQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGXVTXQXVLXAAIPLTSC

SEQ ID NO: 338671 - protein, 25 aa, Artificial Sequence
  Description of Artificial Sequence: Synthetic peptide
  Seed: THTYLEPGPVTAQVVLQAAIPLTSC (PMEL_HUMAN)
  Core: VTAQVVLQA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPXTAXVXLQXAIPLTSC

SEQ ID NO: 338672 - protein, 25 aa, Artificial Sequence
  Description of Artificial Sequence: Synthetic peptide
  Seed: THTYLEPGPVTAQVVLQAAIPLTSC (PMEL_HUMAN)
  Core: TAQVVLQAA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVXAQXVXQAXIPLTSC

SEQ ID NO: 338673 - protein, 25 aa, Artificial Sequence
  Description of Artificial Sequence: Synthetic peptide
  Seed: THTYLEPGPVTAQVVLQAAIPLTSC (PMEL_HUMAN)
  Core: VVLQAAIPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
THTYLEPGPVTAQXVLXAXIPXTSC

SEQ ID NO: 338674 - protein, 13 aa, Artificial Sequence
  Description of Artificial Sequence: Synthetic peptide
  Seed: TIINGSQVWGGQP (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQP

SEQ ID NO: 338675 - protein, 14 aa, Artificial Sequence
  Description of Artificial Sequence: Synthetic peptide
  Seed: TIINGSQVWGGQPV (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPV

SEQ ID NO: 338676 - protein, 15 aa, Artificial Sequence
  Description of Artificial Sequence: Synthetic peptide
  Seed: TIINGSQVWGGQPVY (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVY

SEQ ID NO: 338677 - protein, 16 aa, Artificial Sequence
  Description of Artificial Sequence: Synthetic peptide
  Seed: TIINGSQVWGGQPVYP (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYP

SEQ ID NO: 338678 - protein, 17 aa, Artificial Sequence
  Description of Artificial Sequence: Synthetic peptide
  Seed: TIINGSQVWGGQPVYPQ (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQ

SEQ ID NO: 338679 - protein, 17 aa, Artificial Sequence
  Description of Artificial Sequence: Synthetic peptide
  Seed: TIINGSQVWGGQPVYPQ (PMEL_HUMAN)
  Core: SQVWGGQPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TIINGXQVXGXQPXYPQ

SEQ ID NO: 338680 - protein, 17 aa, Artificial Sequence
  Description of Artificial Sequence: Synthetic peptide
  Seed: TIINGSQVWGGQPVYPQ (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQ

SEQ ID NO: 338681 - protein, 18 aa, Artificial Sequence
  Description of Artificial Sequence: Synthetic peptide
  Seed: TIINGSQVWGGQPVYPQE (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQE

SEQ ID NO: 338682 - protein, 18 aa, Artificial Sequence
  Description of Artificial Sequence: Synthetic peptide
  Seed: TIINGSQVWGGQPVYPQE (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQE

SEQ ID NO: 338683 - protein, 19 aa, Artificial Sequence
  Description of Artificial Sequence: Synthetic peptide
  Seed: TIINGSQVWGGQPVYPQET (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQET

SEQ ID NO: 338684 - protein, 19 aa, Artificial Sequence
  Description of Artificial Sequence: Synthetic peptide
  Seed: TIINGSQVWGGQPVYPQET (PMEL_HUMAN)
  Core: SQVWGGQPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TIINGXQVXGXQPXYPQET

SEQ ID NO: 338685 - protein, 19 aa, Artificial Sequence
  Description of Artificial Sequence: Synthetic peptide
  Seed: TIINGSQVWGGQPVYPQET (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQET

SEQ ID NO: 338686 - protein, 20 aa, Artificial Sequence
  Description of Artificial Sequence: Synthetic peptide
  Seed: TIINGSQVWGGQPVYPQETD (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETD

SEQ ID NO: 338687 - protein, 20 aa, Artificial Sequence
  Description of Artificial Sequence: Synthetic peptide
  Seed: TIINGSQVWGGQPVYPQETD (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETD

SEQ ID NO: 338688 - protein, 20 aa, Artificial Sequence
  Description of Artificial Sequence: Synthetic peptide
  Seed: TIINGSQVWGGQPVYPQETD (PMEL_HUMAN)
  Core: WGGQPVYPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQVXGGXPXYPXETD

SEQ ID NO: 338689 - protein, 21 aa, Artificial Sequence
  Description of Artificial Sequence: Synthetic peptide
  Seed: TIINGSQVWGGQPVYPQETDD (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETDD

SEQ ID NO: 338690 - protein, 21 aa, Artificial Sequence
  Description of Artificial Sequence: Synthetic peptide
  Seed: TIINGSQVWGGQPVYPQETDD (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETDD

SEQ ID NO: 338691 - protein, 22 aa, Artificial Sequence
  Description of Artificial Sequence: Synthetic peptide
  Seed: TIINGSQVWGGQPVYPQETDDA (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETDDA

SEQ ID NO: 338692 - protein, 22 aa, Artificial Sequence
  Description of Artificial Sequence: Synthetic peptide
  Seed: TIINGSQVWGGQPVYPQETDDA (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETDDA

SEQ ID NO: 338693 - protein, 23 aa, Artificial Sequence
  Description of Artificial Sequence: Synthetic peptide
  Seed: TIINGSQVWGGQPVYPQETDDAC (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETDDAC

SEQ ID NO: 338694 - protein, 23 aa, Artificial Sequence
  Description of Artificial Sequence: Synthetic peptide
  Seed: TIINGSQVWGGQPVYPQETDDAC (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETDDAC

SEQ ID NO: 338695 - protein, 24 aa, Artificial Sequence
  Description of Artificial Sequence: Synthetic peptide
  Seed: TIINGSQVWGGQPVYPQETDDACI (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETDDACI

SEQ ID NO: 338696 - protein, 24 aa, Artificial Sequence
  Description of Artificial Sequence: Synthetic peptide
  Seed: TIINGSQVWGGQPVYPQETDDACI (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETDDACI

SEQ ID NO: 338697 - protein, 25 aa, Artificial Sequence
  Description of Artificial Sequence: Synthetic peptide
  Seed: TIINGSQVWGGQPVYPQETDDACIF (PMEL_HUMAN)
  Core: INGSQVWGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TIXNGXQXWGXQPVYPQETDDACIF

SEQ ID NO: 338698 - protein, 25 aa, Artificial Sequence
  Description of Artificial Sequence: Synthetic peptide
  Seed: TIINGSQVWGGQPVYPQETDDACIF (PMEL_HUMAN)
  Core: VWGGQPVYP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQXWGXQXVYXQETDDACIF

SEQ ID NO: 338699 - protein, 25 aa, Artificial Sequence
  Description of Artificial Sequence: Synthetic peptide
  Seed: TIINGSQVWGGQPVYPQETDDACIF (PMEL_HUMAN)
  Core: WGGQPVYPQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TIINGSQVXGGXPXYPXETDDACIF

SEQ ID NO: 338700 - protein, 15 aa, Artificial Sequence
  Description of Artificial Sequence: Synthetic peptide
  Seed: TITDQVPFSVSVSQL (PMEL_HUMAN)
  Core: ITDQVPFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXTDXVXFSXSVSQL

SEQ ID NO: 338701 - protein, 15 aa, Artificial Sequence
  Description of Artificial Sequence: Synthetic peptide
  Seed: TITDQVPFSVSVSQL (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQL

SEQ ID NO: 338702 - protein, 15 aa, Artificial Sequence
  Description of Artificial Sequence: Synthetic peptide
  Seed: TITDQVPFSVSVSQL (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQX

SEQ ID NO: 338703 - protein, 16 aa, Artificial Sequence
  Description of Artificial Sequence: Synthetic peptide
  Seed: TITDQVPFSVSVSQLR (PMEL_HUMAN)
  Core: ITDQVPFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXTDXVXFSXSVSQLR

SEQ ID NO: 338704 - protein, 16 aa, Artificial Sequence
  Description of Artificial Sequence: Synthetic peptide
  Seed: TITDQVPFSVSVSQLR (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLR

SEQ ID NO: 338705 - protein, 16 aa, Artificial Sequence
  Description of Artificial Sequence: Synthetic peptide
  Seed: TITDQVPFSVSVSQLR (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXR

SEQ ID NO: 338706 - protein, 16 aa, Artificial Sequence
  Description of Artificial Sequence: Synthetic peptide
  Seed: TITDQVPFSVSVSQLR (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLX

SEQ ID NO: 338707 - protein, 17 aa, Artificial Sequence
  Description of Artificial Sequence: Synthetic peptide
  Seed: TITDQVPFSVSVSQLRA (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRA

SEQ ID NO: 338708 - protein, 17 aa, Artificial Sequence
  Description of Artificial Sequence: Synthetic peptide
  Seed: TITDQVPFSVSVSQLRA (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRA

SEQ ID NO: 338709 - protein, 17 aa, Artificial Sequence
  Description of Artificial Sequence: Synthetic peptide
  Seed: TITDQVPFSVSVSQLRA (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXA

SEQ ID NO: 338710 - protein, 18 aa, Artificial Sequence
  Description of Artificial Sequence: Synthetic peptide
  Seed: TITDQVPFSVSVSQLRAL (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRAL

SEQ ID NO: 338711 - protein, 18 aa, Artificial Sequence
  Description of Artificial Sequence: Synthetic peptide
  Seed: TITDQVPFSVSVSQLRAL (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRAL

SEQ ID NO: 338712 - protein, 18 aa, Artificial Sequence
  Description of Artificial Sequence: Synthetic peptide
  Seed: TITDQVPFSVSVSQLRAL (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXAL

SEQ ID NO: 338713 - protein, 18 aa, Artificial Sequence
  Description of Artificial Sequence: Synthetic peptide
  Seed: TITDQVPFSVSVSQLRAL (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAX

SEQ ID NO: 338714 - protein, 19 aa, Artificial Sequence
  Description of Artificial Sequence: Synthetic peptide
  Seed: TITDQVPFSVSVSQLRALD (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRALD

SEQ ID NO: 338715 - protein, 19 aa, Artificial Sequence
  Description of Artificial Sequence: Synthetic peptide
  Seed: TITDQVPFSVSVSQLRALD (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALD

SEQ ID NO: 338716 - protein, 19 aa, Artificial Sequence
  Description of Artificial Sequence: Synthetic peptide
  Seed: TITDQVPFSVSVSQLRALD (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALD

SEQ ID NO: 338717 - protein, 19 aa, Artificial Sequence
  Description of Artificial Sequence: Synthetic peptide
  Seed: TITDQVPFSVSVSQLRALD (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXD

SEQ ID NO: 338718 - protein, 20 aa, Artificial Sequence
  Description of Artificial Sequence: Synthetic peptide
  Seed: TITDQVPFSVSVSQLRALDG (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRALDG

SEQ ID NO: 338719 - protein, 20 aa, Artificial Sequence
  Description of Artificial Sequence: Synthetic peptide
  Seed: TITDQVPFSVSVSQLRALDG (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDG

SEQ ID NO: 338720 - protein, 20 aa, Artificial Sequence
  Description of Artificial Sequence: Synthetic peptide
  Seed: TITDQVPFSVSVSQLRALDG (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDG

SEQ ID NO: 338721 - protein, 20 aa, Artificial Sequence
  Description of Artificial Sequence: Synthetic peptide
  Seed: TITDQVPFSVSVSQLRALDG (PMEL_HUMAN)
  Core: SVSVSQLRA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFXVSXSXLRXLDG

SEQ ID NO: 338722 - protein, 20 aa, Artificial Sequence
  Description of Artificial Sequence: Synthetic peptide
  Seed: TITDQVPFSVSVSQLRALDG (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDG

SEQ ID NO: 338723 - protein, 21 aa, Artificial Sequence
  Description of Artificial Sequence: Synthetic peptide
  Seed: TITDQVPFSVSVSQLRALDGG (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRALDGG

SEQ ID NO: 338724 - protein, 21 aa, Artificial Sequence
  Description of Artificial Sequence: Synthetic peptide
  Seed: TITDQVPFSVSVSQLRALDGG (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDGG

SEQ ID NO: 338725 - protein, 21 aa, Artificial Sequence
  Description of Artificial Sequence: Synthetic peptide
  Seed: TITDQVPFSVSVSQLRALDGG (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDGG

SEQ ID NO: 338726 - protein, 21 aa, Artificial Sequence
  Description of Artificial Sequence: Synthetic peptide
  Seed: TITDQVPFSVSVSQLRALDGG (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDGG

SEQ ID NO: 338727 - protein, 22 aa, Artificial Sequence
  Description of Artificial Sequence: Synthetic peptide
  Seed: TITDQVPFSVSVSQLRALDGGN (PMEL_HUMAN)
  Core: QVPFSVSVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TITDXVPXSXSVXQLRALDGGN

SEQ ID NO: 338728 - protein, 22 aa, Artificial Sequence
  Description of Artificial Sequence: Synthetic peptide
  Seed: TITDQVPFSVSVSQLRALDGGN (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDGGN

SEQ ID NO: 338729 - protein, 22 aa, Artificial Sequence
  Description of Artificial Sequence: Synthetic peptide
  Seed: TITDQVPFSVSVSQLRALDGGN (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDGGN

SEQ ID NO: 338730 - protein, 22 aa, Artificial Sequence
  Description of Artificial Sequence: Synthetic peptide
  Seed: TITDQVPFSVSVSQLRALDGGN (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDGGN

SEQ ID NO: 338731 - protein, 22 aa, Artificial Sequence
  Description of Artificial Sequence: Synthetic peptide
  Seed: TITDQVPFSVSVSQLRALDGGN (PMEL_HUMAN)
  Core: VSQLRALDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSVSXSQXRXLDXGN

SEQ ID NO: 338732 - protein, 23 aa, Artificial Sequence
  Description of Artificial Sequence: Synthetic peptide
  Seed: TITDQVPFSVSVSQLRALDGGNK (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDGGNK

SEQ ID NO: 338733 - protein, 23 aa, Artificial Sequence
  Description of Artificial Sequence: Synthetic peptide
  Seed: TITDQVPFSVSVSQLRALDGGNK (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDGGNK

SEQ ID NO: 338734 - protein, 23 aa, Artificial Sequence
  Description of Artificial Sequence: Synthetic peptide
  Seed: TITDQVPFSVSVSQLRALDGGNK (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDGGNK

SEQ ID NO: 338735 - protein, 23 aa, Artificial Sequence
  Description of Artificial Sequence: Synthetic peptide
  Seed: TITDQVPFSVSVSQLRALDGGNK (PMEL_HUMAN)
  Core: VSQLRALDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSVSXSQXRXLDXGNK

SEQ ID NO: 338736 - protein, 24 aa, Artificial Sequence
  Description of Artificial Sequence: Synthetic peptide
  Seed: TITDQVPFSVSVSQLRALDGGNKH (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDGGNKH

SEQ ID NO: 338737 - protein, 24 aa, Artificial Sequence
  Description of Artificial Sequence: Synthetic peptide
  Seed: TITDQVPFSVSVSQLRALDGGNKH (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDGGNKH

SEQ ID NO: 338738 - protein, 24 aa, Artificial Sequence
  Description of Artificial Sequence: Synthetic peptide
  Seed: TITDQVPFSVSVSQLRALDGGNKH (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDGGNKH

SEQ ID NO: 338739 - protein, 24 aa, Artificial Sequence
  Description of Artificial Sequence: Synthetic peptide
  Seed: TITDQVPFSVSVSQLRALDGGNKH (PMEL_HUMAN)
  Core: VSQLRALDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSVSXSQXRXLDXGNKH

SEQ ID NO: 338740 - protein, 25 aa, Artificial Sequence
  Description of Artificial Sequence: Synthetic peptide
  Seed: TITDQVPFSVSVSQLRALDGGNKHF (PMEL_HUMAN)
  Core: PFSVSVSQL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVXFSXSXSQXRALDGGNKHF

SEQ ID NO: 338741 - protein, 25 aa, Artificial Sequence
  Description of Artificial Sequence: Synthetic peptide
  Seed: TITDQVPFSVSVSQLRALDGGNKHF (PMEL_HUMAN)
  Core: FSVSVSQLR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPXSVXVXQLXALDGGNKHF

SEQ ID NO: 338742 - protein, 25 aa, Artificial Sequence
  Description of Artificial Sequence: Synthetic peptide
  Seed: TITDQVPFSVSVSQLRALDGGNKHF (PMEL_HUMAN)
  Core: VSVSQLRAL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSXSVXQXRAXDGGNKHF

SEQ ID NO: 338743 - protein, 25 aa, Artificial Sequence
  Description of Artificial Sequence: Synthetic peptide
  Seed: TITDQVPFSVSVSQLRALDGGNKHF (PMEL_HUMAN)
  Core: VSQLRALDG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TITDQVPFSVSXSQXRXLDXGNKHF

SEQ ID NO: 338744 - protein, 19 aa, Artificial Sequence
  Description of Artificial Sequence: Synthetic peptide
  Seed: TKAWNRQLYPEWTEAQRLD (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLD

SEQ ID NO: 338745 - protein, 20 aa, Artificial Sequence
  Description of Artificial Sequence: Synthetic peptide
  Seed: TKAWNRQLYPEWTEAQRLDC (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDC

SEQ ID NO: 338746 - protein, 21 aa, Artificial Sequence
  Description of Artificial Sequence: Synthetic peptide
  Seed: TKAWNRQLYPEWTEAQRLDCW (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDCW

SEQ ID NO: 338747 - protein, 22 aa, Artificial Sequence
  Description of Artificial Sequence: Synthetic peptide
  Seed: TKAWNRQLYPEWTEAQRLDCWR (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDCWR

SEQ ID NO: 338748 - protein, 23 aa, Artificial Sequence
  Description of Artificial Sequence: Synthetic peptide
  Seed: TKAWNRQLYPEWTEAQRLDCWRG (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDCWRG

SEQ ID NO: 338749 - protein, 24 aa, Artificial Sequence
  Description of Artificial Sequence: Synthetic peptide
  Seed: TKAWNRQLYPEWTEAQRLDCWRGG (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDCWRGG

SEQ ID NO: 338750 - protein, 25 aa, Artificial Sequence
  Description of Artificial Sequence: Synthetic peptide
  Seed: TKAWNRQLYPEWTEAQRLDCWRGGQ (PMEL_HUMAN)
  Core: LYPEWTEAQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TKAWNRQXYPXWXEAXRLDCWRGGQ

SEQ ID NO: 338751 - protein, 19 aa, Artificial Sequence
  Description of Artificial Sequence: Synthetic peptide
  Seed: TKVPRNQDWLGVSRQLRTK (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTK

SEQ ID NO: 338752 - protein, 20 aa, Artificial Sequence
  Description of Artificial Sequence: Synthetic peptide
  Seed: TKVPRNQDWLGVSRQLRTKA (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKA

SEQ ID NO: 338753 - protein, 20 aa, Artificial Sequence
  Description of Artificial Sequence: Synthetic peptide
  Seed: TKVPRNQDWLGVSRQLRTKA (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKA

SEQ ID NO: 338754 - protein, 20 aa, Artificial Sequence
  Description of Artificial Sequence: Synthetic peptide
  Seed: TKVPRNQDWLGVSRQLRTKA (PMEL_HUMAN)
  Core: LGVSRQLRT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDWXGVXRXLRXKA

SEQ ID NO: 338755 - protein, 21 aa, Artificial Sequence
  Description of Artificial Sequence: Synthetic peptide
  Seed: TKVPRNQDWLGVSRQLRTKAW (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKAW

SEQ ID NO: 338756 - protein, 21 aa, Artificial Sequence
  Description of Artificial Sequence: Synthetic peptide
  Seed: TKVPRNQDWLGVSRQLRTKAW (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKAW

SEQ ID NO: 338757 - protein, 22 aa, Artificial Sequence
  Description of Artificial Sequence: Synthetic peptide
  Seed: TKVPRNQDWLGVSRQLRTKAWN (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKAWN

SEQ ID NO: 338758 - protein, 22 aa, Artificial Sequence
  Description of Artificial Sequence: Synthetic peptide
  Seed: TKVPRNQDWLGVSRQLRTKAWN (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKAWN

SEQ ID NO: 338759 - protein, 23 aa, Artificial Sequence
  Description of Artificial Sequence: Synthetic peptide
  Seed: TKVPRNQDWLGVSRQLRTKAWNR (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKAWNR

SEQ ID NO: 338760 - protein, 23 aa, Artificial Sequence
  Description of Artificial Sequence: Synthetic peptide
  Seed: TKVPRNQDWLGVSRQLRTKAWNR (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKAWNR

SEQ ID NO: 338761 - protein, 24 aa, Artificial Sequence
  Description of Artificial Sequence: Synthetic peptide
  Seed: TKVPRNQDWLGVSRQLRTKAWNRQ (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKAWNRQ

SEQ ID NO: 338762 - protein, 24 aa, Artificial Sequence
  Description of Artificial Sequence: Synthetic peptide
  Seed: TKVPRNQDWLGVSRQLRTKAWNRQ (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKAWNRQ

SEQ ID NO: 338763 - protein, 24 aa, Artificial Sequence
  Description of Artificial Sequence: Synthetic peptide
  Seed: TKVPRNQDWLGVSRQLRTKAWNRQ (PMEL_HUMAN)
  Core: LGVSRQLRT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDWXGVXRXLRXKAWNRQ

SEQ ID NO: 338764 - protein, 25 aa, Artificial Sequence
  Description of Artificial Sequence: Synthetic peptide
  Seed: TKVPRNQDWLGVSRQLRTKAWNRQL (PMEL_HUMAN)
  Core: RNQDWLGVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TKVPXNQXWXGVXRQLRTKAWNRQL

SEQ ID NO: 338765 - protein, 25 aa, Artificial Sequence
  Description of Artificial Sequence: Synthetic peptide
  Seed: TKVPRNQDWLGVSRQLRTKAWNRQL (PMEL_HUMAN)
  Core: WLGVSRQLR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDXLGXSXQLXTKAWNRQL

SEQ ID NO: 338766 - protein, 25 aa, Artificial Sequence
  Description of Artificial Sequence: Synthetic peptide
  Seed: TKVPRNQDWLGVSRQLRTKAWNRQL (PMEL_HUMAN)
  Core: LGVSRQLRT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDWXGVXRXLRXKAWNRQL

SEQ ID NO: 338767 - protein, 25 aa, Artificial Sequence
  Description of Artificial Sequence: Synthetic peptide
  Seed: TKVPRNQDWLGVSRQLRTKAWNRQL (PMEL_HUMAN)
  Core: LRTKAWNRQ
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TKVPRNQDWLGVSRQXRTXAXNRXL

SEQ ID NO: 338768 - protein, 13 aa, Artificial Sequence
  Description of Artificial Sequence: Synthetic peptide
  Seed: TLAEMSTPEATGM (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGM

SEQ ID NO: 338769 - protein, 14 aa, Artificial Sequence
  Description of Artificial Sequence: Synthetic peptide
  Seed: TLAEMSTPEATGMT (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGMT

SEQ ID NO: 338770 - protein, 15 aa, Artificial Sequence
  Description of Artificial Sequence: Synthetic peptide
  Seed: TLAEMSTPEATGMTP (PMEL_HUMAN)
  Core: LAEMSTPEA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXAEXSXPEXTGMTP

SEQ ID NO: 338771 - protein, 15 aa, Artificial Sequence
  Description of Artificial Sequence: Synthetic peptide
  Seed: TLAEMSTPEATGMTP (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGMTP

SEQ ID NO: 338772 - protein, 16 aa, Artificial Sequence
  Description of Artificial Sequence: Synthetic peptide
  Seed: TLAEMSTPEATGMTPA (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGMTPA

SEQ ID NO: 338773 - protein, 17 aa, Artificial Sequence
  Description of Artificial Sequence: Synthetic peptide
  Seed: TLAEMSTPEATGMTPAE (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGMTPAE

SEQ ID NO: 338774 - protein, 18 aa, Artificial Sequence
  Description of Artificial Sequence: Synthetic peptide
  Seed: TLAEMSTPEATGMTPAEV (PMEL_HUMAN)
  Core: AEMSTPEAT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXEMXTXEAXGMTPAEV

SEQ ID NO: 338775 - protein, 19 aa, Artificial Sequence
  Description of Artificial Sequence: Synthetic peptide
  Seed: TLAEMSTPEATGMTPAEVS (PMEL_HUMAN)
  Core: EATGMTPAE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPXATXMXPAXVS

SEQ ID NO: 338776 - protein, 19 aa, Artificial Sequence
  Description of Artificial Sequence: Synthetic peptide
  Seed: TLAEMSTPEATGMTPAEVS (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXS

SEQ ID NO: 338777 - protein, 20 aa, Artificial Sequence
  Description of Artificial Sequence: Synthetic peptide
  Seed: TLAEMSTPEATGMTPAEVSI (PMEL_HUMAN)
  Core: EATGMTPAE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPXATXMXPAXVSI

SEQ ID NO: 338778 - protein, 20 aa, Artificial Sequence
  Description of Artificial Sequence: Synthetic peptide
  Seed: TLAEMSTPEATGMTPAEVSI (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSI

SEQ ID NO: 338779 - protein, 21 aa, Artificial Sequence
  Description of Artificial Sequence: Synthetic peptide
  Seed: TLAEMSTPEATGMTPAEVSIV (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSIV

SEQ ID NO: 338780 - protein, 22 aa, Artificial Sequence
  Description of Artificial Sequence: Synthetic peptide
  Seed: TLAEMSTPEATGMTPAEVSIVV (PMEL_HUMAN)
  Core: EATGMTPAE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPXATXMXPAXVSIVV

SEQ ID NO: 338781 - protein, 22 aa, Artificial Sequence
  Description of Artificial Sequence: Synthetic peptide
  Seed: TLAEMSTPEATGMTPAEVSIVV (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSIVV

SEQ ID NO: 338782 - protein, 23 aa, Artificial Sequence
  Description of Artificial Sequence: Synthetic peptide
  Seed: TLAEMSTPEATGMTPAEVSIVVL (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSIVVL

SEQ ID NO: 338783 - protein, 23 aa, Artificial Sequence
  Description of Artificial Sequence: Synthetic peptide
  Seed: TLAEMSTPEATGMTPAEVSIVVL (PMEL_HUMAN)
  Core: MTPAEVSIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEATGXTPXEXSIXVL

SEQ ID NO: 338784 - protein, 24 aa, Artificial Sequence
  Description of Artificial Sequence: Synthetic peptide
  Seed: TLAEMSTPEATGMTPAEVSIVVLS (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSIVVLS

SEQ ID NO: 338785 - protein, 24 aa, Artificial Sequence
  Description of Artificial Sequence: Synthetic peptide
  Seed: TLAEMSTPEATGMTPAEVSIVVLS (PMEL_HUMAN)
  Core: MTPAEVSIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEATGXTPXEXSIXVLS

SEQ ID NO: 338786 - protein, 25 aa, Artificial Sequence
  Description of Artificial Sequence: Synthetic peptide
  Seed: TLAEMSTPEATGMTPAEVSIVVLSG (PMEL_HUMAN)
  Core: ATGMTPAEV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEXTGXTXAEXSIVVLSG

SEQ ID NO: 338787 - protein, 25 aa, Artificial Sequence
  Description of Artificial Sequence: Synthetic peptide
  Seed: TLAEMSTPEATGMTPAEVSIVVLSG (PMEL_HUMAN)
  Core: MTPAEVSIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLAEMSTPEATGXTPXEXSIXVLSG

SEQ ID NO: 338788 - protein, 13 aa, Artificial Sequence
  Description of Artificial Sequence: Synthetic peptide
  Seed: TLDIVQGIESAEI (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEX

SEQ ID NO: 338789 - protein, 14 aa, Artificial Sequence
  Description of Artificial Sequence: Synthetic peptide
  Seed: TLDIVQGIESAEIL (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXL

SEQ ID NO: 338790 - protein, 15 aa, Artificial Sequence
  Description of Artificial Sequence: Synthetic peptide
  Seed: TLDIVQGIESAEILQ (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQ

SEQ ID NO: 338791 - protein, 16 aa, Artificial Sequence
  Description of Artificial Sequence: Synthetic peptide
  Seed: TLDIVQGIESAEILQA (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQA

SEQ ID NO: 338792 - protein, 16 aa, Artificial Sequence
  Description of Artificial Sequence: Synthetic peptide
  Seed: TLDIVQGIESAEILQA (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQX

SEQ ID NO: 338793 - protein, 17 aa, Artificial Sequence
  Description of Artificial Sequence: Synthetic peptide
  Seed: TLDIVQGIESAEILQAV (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQAV

SEQ ID NO: 338794 - protein, 17 aa, Artificial Sequence
  Description of Artificial Sequence: Synthetic peptide
  Seed: TLDIVQGIESAEILQAV (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXV

SEQ ID NO: 338795 - protein, 18 aa, Artificial Sequence
  Description of Artificial Sequence: Synthetic peptide
  Seed: TLDIVQGIESAEILQAVP (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQAVP

SEQ ID NO: 338796 - protein, 18 aa, Artificial Sequence
  Description of Artificial Sequence: Synthetic peptide
  Seed: TLDIVQGIESAEILQAVP (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVP

SEQ ID NO: 338797 - protein, 19 aa, Artificial Sequence
  Description of Artificial Sequence: Synthetic peptide
  Seed: TLDIVQGIESAEILQAVPS (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQAVPS

SEQ ID NO: 338798 - protein, 19 aa, Artificial Sequence
  Description of Artificial Sequence: Synthetic peptide
  Seed: TLDIVQGIESAEILQAVPS (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPS

SEQ ID NO: 338799 - protein, 20 aa, Artificial Sequence
  Description of Artificial Sequence: Synthetic peptide
  Seed: TLDIVQGIESAEILQAVPSG (PMEL_HUMAN)
  Core: VQGIESAEI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLDIXQGXEXAEXLQAVPSG

SEQ ID NO: 338800 - protein, 20 aa, Artificial Sequence
  Description of Artificial Sequence: Synthetic peptide
  Seed: TLDIVQGIESAEILQAVPSG (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSG

SEQ ID NO: 338801 - protein, 21 aa, Artificial Sequence
  Description of Artificial Sequence: Synthetic peptide
  Seed: TLDIVQGIESAEILQAVPSGE (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSGE

SEQ ID NO: 338802 - protein, 21 aa, Artificial Sequence
  Description of Artificial Sequence: Synthetic peptide
  Seed: TLDIVQGIESAEILQAVPSGE (PMEL_HUMAN)
  Core: ESAEILQAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIXSAXIXQAXPSGE

SEQ ID NO: 338803 - protein, 21 aa, Artificial Sequence
  Description of Artificial Sequence: Synthetic peptide
  Seed: TLDIVQGIESAEILQAVPSGE (PMEL_HUMAN)
  Core: AEILQAVPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESXEIXQXVPXGE

SEQ ID NO: 338804 - protein, 22 aa, Artificial Sequence
  Description of Artificial Sequence: Synthetic peptide
  Seed: TLDIVQGIESAEILQAVPSGEG (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSGEG

SEQ ID NO: 338805 - protein, 22 aa, Artificial Sequence
  Description of Artificial Sequence: Synthetic peptide
  Seed: TLDIVQGIESAEILQAVPSGEG (PMEL_HUMAN)
  Core: ESAEILQAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIXSAXIXQAXPSGEG

SEQ ID NO: 338806 - protein, 22 aa, Artificial Sequence
  Description of Artificial Sequence: Synthetic peptide
  Seed: TLDIVQGIESAEILQAVPSGEG (PMEL_HUMAN)
  Core: AEILQAVPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESXEIXQXVPXGEG

SEQ ID NO: 338807 - protein, 23 aa, Artificial Sequence
  Description of Artificial Sequence: Synthetic peptide
  Seed: TLDIVQGIESAEILQAVPSGEGD (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSGEGD

SEQ ID NO: 338808 - protein, 23 aa, Artificial Sequence
  Description of Artificial Sequence: Synthetic peptide
  Seed: TLDIVQGIESAEILQAVPSGEGD (PMEL_HUMAN)
  Core: ESAEILQAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIXSAXIXQAXPSGEGD

SEQ ID NO: 338809 - protein, 23 aa, Artificial Sequence
  Description of Artificial Sequence: Synthetic peptide
  Seed: TLDIVQGIESAEILQAVPSGEGD (PMEL_HUMAN)
  Core: AEILQAVPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESXEIXQXVPXGEGD

SEQ ID NO: 338810 - protein, 24 aa, Artificial Sequence
  Description of Artificial Sequence: Synthetic peptide
  Seed: TLDIVQGIESAEILQAVPSGEGDA (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSGEGDA

SEQ ID NO: 338811 - protein, 24 aa, Artificial Sequence
  Description of Artificial Sequence: Synthetic peptide
  Seed: TLDIVQGIESAEILQAVPSGEGDA (PMEL_HUMAN)
  Core: ESAEILQAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIXSAXIXQAXPSGEGDA

SEQ ID NO: 338812 - protein, 24 aa, Artificial Sequence
  Description of Artificial Sequence: Synthetic peptide
  Seed: TLDIVQGIESAEILQAVPSGEGDA (PMEL_HUMAN)
  Core: AEILQAVPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESXEIXQXVPXGEGDA

SEQ ID NO: 338813 - protein, 24 aa, Artificial Sequence
  Description of Artificial Sequence: Synthetic peptide
  Seed: TLDIVQGIESAEILQAVPSGEGDA (PMEL_HUMAN)
  Core: ILQAVPSGE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESAEXLQXVXSGXGDA

SEQ ID NO: 338814 - protein, 24 aa, Artificial Sequence
  Description of Artificial Sequence: Synthetic peptide
  Seed: TLDIVQGIESAEILQAVPSGEGDA (PMEL_HUMAN)
  Core: LQAVPSGEG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESAEIXQAXPXGEXDA

SEQ ID NO: 338815 - protein, 25 aa, Artificial Sequence
  Description of Artificial Sequence: Synthetic peptide
  Seed: TLDIVQGIESAEILQAVPSGEGDAF (PMEL_HUMAN)
  Core: IESAEILQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGXESXEXLQXVPSGEGDAF

SEQ ID NO: 338816 - protein, 25 aa, Artificial Sequence
  Description of Artificial Sequence: Synthetic peptide
  Seed: TLDIVQGIESAEILQAVPSGEGDAF (PMEL_HUMAN)
  Core: ESAEILQAV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIXSAXIXQAXPSGEGDAF

SEQ ID NO: 338817 - protein, 25 aa, Artificial Sequence
  Description of Artificial Sequence: Synthetic peptide
  Seed: TLDIVQGIESAEILQAVPSGEGDAF (PMEL_HUMAN)
  Core: AEILQAVPS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESXEIXQXVPXGEGDAF

SEQ ID NO: 338818 - protein, 25 aa, Artificial Sequence
  Description of Artificial Sequence: Synthetic peptide
  Seed: TLDIVQGIESAEILQAVPSGEGDAF (PMEL_HUMAN)
  Core: ILQAVPSGE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESAEXLQXVXSGXGDAF

SEQ ID NO: 338819 - protein, 25 aa, Artificial Sequence
  Description of Artificial Sequence: Synthetic peptide
  Seed: TLDIVQGIESAEILQAVPSGEGDAF (PMEL_HUMAN)
  Core: LQAVPSGEG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TLDIVQGIESAEIXQAXPXGEXDAF

SEQ ID NO: 338820 - protein, 13 aa, Artificial Sequence
  Description of Artificial Sequence: Synthetic peptide
  Seed: TLIGANASFSIAL (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIAL

SEQ ID NO: 338821 - protein, 13 aa, Artificial Sequence
  Description of Artificial Sequence: Synthetic peptide
  Seed: TLIGANASFSIAL (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXAL

SEQ ID NO: 338822 - protein, 14 aa, Artificial Sequence
  Description of Artificial Sequence: Synthetic peptide
  Seed: TLIGANASFSIALN (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALN

SEQ ID NO: 338823 - protein, 14 aa, Artificial Sequence
  Description of Artificial Sequence: Synthetic peptide
  Seed: TLIGANASFSIALN (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALN

SEQ ID NO: 338824 - protein, 14 aa, Artificial Sequence
  Description of Artificial Sequence: Synthetic peptide
  Seed: TLIGANASFSIALN (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALX

SEQ ID NO: 338825 - protein, 15 aa, Artificial Sequence
  Description of Artificial Sequence: Synthetic peptide
  Seed: TLIGANASFSIALNF (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALNF

SEQ ID NO: 338826 - protein, 15 aa, Artificial Sequence
  Description of Artificial Sequence: Synthetic peptide
  Seed: TLIGANASFSIALNF (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALNF

SEQ ID NO: 338827 - protein, 15 aa, Artificial Sequence
  Description of Artificial Sequence: Synthetic peptide
  Seed: TLIGANASFSIALNF (PMEL_HUMAN)
  Core: GANASFSIA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXANXSXSIXLNF

SEQ ID NO: 338828 - protein, 15 aa, Artificial Sequence
  Description of Artificial Sequence: Synthetic peptide
  Seed: TLIGANASFSIALNF (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXF

SEQ ID NO: 338829 - protein, 16 aa, Artificial Sequence
  Description of Artificial Sequence: Synthetic peptide
  Seed: TLIGANASFSIALNFP (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALNFP

SEQ ID NO: 338830 - protein, 16 aa, Artificial Sequence
  Description of Artificial Sequence: Synthetic peptide
  Seed: TLIGANASFSIALNFP (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALNFP

SEQ ID NO: 338831 - protein, 16 aa, Artificial Sequence
  Description of Artificial Sequence: Synthetic peptide
  Seed: TLIGANASFSIALNFP (PMEL_HUMAN)
  Core: ANASFSIAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLIGXNAXFXIAXNFP

SEQ ID NO: 338832 - protein, 16 aa, Artificial Sequence
  Description of Artificial Sequence: Synthetic peptide
  Seed: TLIGANASFSIALNFP (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFP

SEQ ID NO: 338833 - protein, 16 aa, Artificial Sequence
  Description of Artificial Sequence: Synthetic peptide
  Seed: TLIGANASFSIALNFP (PMEL_HUMAN)
  Core: ASFSIALNF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANXSFXIXLNXP

SEQ ID NO: 338834 - protein, 17 aa, Artificial Sequence
  Description of Artificial Sequence: Synthetic peptide
  Seed: TLIGANASFSIALNFPG (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALNFPG

SEQ ID NO: 338835 - protein, 17 aa, Artificial Sequence
  Description of Artificial Sequence: Synthetic peptide
  Seed: TLIGANASFSIALNFPG (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALNFPG

SEQ ID NO: 338836 - protein, 17 aa, Artificial Sequence
  Description of Artificial Sequence: Synthetic peptide
  Seed: TLIGANASFSIALNFPG (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPG

SEQ ID NO: 338837 - protein, 17 aa, Artificial Sequence
  Description of Artificial Sequence: Synthetic peptide
  Seed: TLIGANASFSIALNFPG (PMEL_HUMAN)
  Core: ASFSIALNF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANXSFXIXLNXPG

SEQ ID NO: 338838 - protein, 17 aa, Artificial Sequence
  Description of Artificial Sequence: Synthetic peptide
  Seed: TLIGANASFSIALNFPG (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPX

SEQ ID NO: 338839 - protein, 18 aa, Artificial Sequence
  Description of Artificial Sequence: Synthetic peptide
  Seed: TLIGANASFSIALNFPGS (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALNFPGS

SEQ ID NO: 338840 - protein, 18 aa, Artificial Sequence
  Description of Artificial Sequence: Synthetic peptide
  Seed: TLIGANASFSIALNFPGS (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALNFPGS

SEQ ID NO: 338841 - protein, 18 aa, Artificial Sequence
  Description of Artificial Sequence: Synthetic peptide
  Seed: TLIGANASFSIALNFPGS (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGS

SEQ ID NO: 338842 - protein, 18 aa, Artificial Sequence
  Description of Artificial Sequence: Synthetic peptide
  Seed: TLIGANASFSIALNFPGS (PMEL_HUMAN)
  Core: ASFSIALNF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANXSFXIXLNXPGS

SEQ ID NO: 338843 - protein, 18 aa, Artificial Sequence
  Description of Artificial Sequence: Synthetic peptide
  Seed: TLIGANASFSIALNFPGS (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXS

SEQ ID NO: 338844 - protein, 19 aa, Artificial Sequence
  Description of Artificial Sequence: Synthetic peptide
  Seed: TLIGANASFSIALNFPGSQ (PMEL_HUMAN)
  Core: LIGANASFS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXIGXNXSFXIALNFPGSQ

SEQ ID NO: 338845 - protein, 19 aa, Artificial Sequence
  Description of Artificial Sequence: Synthetic peptide
  Seed: TLIGANASFSIALNFPGSQ (PMEL_HUMAN)
  Core: IGANASFSI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXGAXAXFSXALNFPGSQ

SEQ ID NO: 338846 - protein, 19 aa, Artificial Sequence
  Description of Artificial Sequence: Synthetic peptide
  Seed: TLIGANASFSIALNFPGSQ (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQ

SEQ ID NO: 338847 - protein, 19 aa, Artificial Sequence
  Description of Artificial Sequence: Synthetic peptide
  Seed: TLIGANASFSIALNFPGSQ (PMEL_HUMAN)
  Core: ASFSIALNF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANXSFXIXLNXPGSQ

SEQ ID NO: 338848 - protein, 19 aa, Artificial Sequence
  Description of Artificial Sequence: Synthetic peptide
  Seed: TLIGANASFSIALNFPGSQ (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQ

SEQ ID NO: 338849 - protein, 20 aa, Artificial Sequence
  Description of Artificial Sequence: Synthetic peptide
  Seed: TLIGANASFSIALNFPGSQK (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQK

SEQ ID NO: 338850 - protein, 20 aa, Artificial Sequence
  Description of Artificial Sequence: Synthetic peptide
  Seed: TLIGANASFSIALNFPGSQK (PMEL_HUMAN)
  Core: ASFSIALNF
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANXSFXIXLNXPGSQK

SEQ ID NO: 338851 - protein, 20 aa, Artificial Sequence
  Description of Artificial Sequence: Synthetic peptide
  Seed: TLIGANASFSIALNFPGSQK (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQK

SEQ ID NO: 338852 - protein, 21 aa, Artificial Sequence
  Description of Artificial Sequence: Synthetic peptide
  Seed: TLIGANASFSIALNFPGSQKV (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQKV

SEQ ID NO: 338853 - protein, 21 aa, Artificial Sequence
  Description of Artificial Sequence: Synthetic peptide
  Seed: TLIGANASFSIALNFPGSQKV (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQKV

SEQ ID NO: 338854 - protein, 22 aa, Artificial Sequence
  Description of Artificial Sequence: Synthetic peptide
  Seed: TLIGANASFSIALNFPGSQKVL (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQKVL

SEQ ID NO: 338855 - protein, 22 aa, Artificial Sequence
  Description of Artificial Sequence: Synthetic peptide
  Seed: TLIGANASFSIALNFPGSQKVL (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQKVL

SEQ ID NO: 338856 - protein, 23 aa, Artificial Sequence
  Description of Artificial Sequence: Synthetic peptide
  Seed: TLIGANASFSIALNFPGSQKVLP (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQKVLP

SEQ ID NO: 338857 - protein, 23 aa, Artificial Sequence
  Description of Artificial Sequence: Synthetic peptide
  Seed: TLIGANASFSIALNFPGSQKVLP (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQKVLP

SEQ ID NO: 338858 - protein, 24 aa, Artificial Sequence
  Description of Artificial Sequence: Synthetic peptide
  Seed: TLIGANASFSIALNFPGSQKVLPD (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQKVLPD

SEQ ID NO: 338859 - protein, 24 aa, Artificial Sequence
  Description of Artificial Sequence: Synthetic peptide
  Seed: TLIGANASFSIALNFPGSQKVLPD (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQKVLPD

SEQ ID NO: 338860 - protein, 24 aa, Artificial Sequence
  Description of Artificial Sequence: Synthetic peptide
  Seed: TLIGANASFSIALNFPGSQKVLPD (PMEL_HUMAN)
  Core: LNFPGSQKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASFSIAXNFXGXQKXLPD

SEQ ID NO: 338861 - protein, 25 aa, Artificial Sequence
  Description of Artificial Sequence: Synthetic peptide
  Seed: TLIGANASFSIALNFPGSQKVLPDG (PMEL_HUMAN)
  Core: NASFSIALN
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLIGAXASXSXALXFPGSQKVLPDG

SEQ ID NO: 338862 - protein, 25 aa, Artificial Sequence
  Description of Artificial Sequence: Synthetic peptide
  Seed: TLIGANASFSIALNFPGSQKVLPDG (PMEL_HUMAN)
  Core: FSIALNFPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASXSIXLXFPXSQKVLPDG

SEQ ID NO: 338863 - protein, 25 aa, Artificial Sequence
  Description of Artificial Sequence: Synthetic peptide
  Seed: TLIGANASFSIALNFPGSQKVLPDG (PMEL_HUMAN)
  Core: LNFPGSQKV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLIGANASFSIAXNFXGXQKXLPDG

SEQ ID NO: 338864 - protein, 13 aa, Artificial Sequence
  Description of Artificial Sequence: Synthetic peptide
  Seed: TLISRALVVTHTY (PMEL_HUMAN)
  Core: ISRALVVTH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXSRXLXVTXTY

SEQ ID NO: 338865 - protein, 13 aa, Artificial Sequence
  Description of Artificial Sequence: Synthetic peptide
  Seed: TLISRALVVTHTY (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXY

SEQ ID NO: 338866 - protein, 14 aa, Artificial Sequence
  Description of Artificial Sequence: Synthetic peptide
  Seed: TLISRALVVTHTYL (PMEL_HUMAN)
  Core: ISRALVVTH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXSRXLXVTXTYL

SEQ ID NO: 338867 - protein, 14 aa, Artificial Sequence
  Description of Artificial Sequence: Synthetic peptide
  Seed: TLISRALVVTHTYL (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYL

SEQ ID NO: 338868 - protein, 14 aa, Artificial Sequence
  Description of Artificial Sequence: Synthetic peptide
  Seed: TLISRALVVTHTYL (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXL

SEQ ID NO: 338869 - protein, 15 aa, Artificial Sequence
  Description of Artificial Sequence: Synthetic peptide
  Seed: TLISRALVVTHTYLE (PMEL_HUMAN)
  Core: LISRALVVT
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXISXAXVVXHTYLE

SEQ ID NO: 338870 - protein, 15 aa, Artificial Sequence
  Description of Artificial Sequence: Synthetic peptide
  Seed: TLISRALVVTHTYLE (PMEL_HUMAN)
  Core: ISRALVVTH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXSRXLXVTXTYLE

SEQ ID NO: 338871 - protein, 15 aa, Artificial Sequence
  Description of Artificial Sequence: Synthetic peptide
  Seed: TLISRALVVTHTYLE (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLE

SEQ ID NO: 338872 - protein, 15 aa, Artificial Sequence
  Description of Artificial Sequence: Synthetic peptide
  Seed: TLISRALVVTHTYLE (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXLE

SEQ ID NO: 338873 - protein, 15 aa, Artificial Sequence
  Description of Artificial Sequence: Synthetic peptide
  Seed: TLISRALVVTHTYLE (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLX

SEQ ID NO: 338874 - protein, 16 aa, Artificial Sequence
  Description of Artificial Sequence: Synthetic peptide
  Seed: TLISRALVVTHTYLEP (PMEL_HUMAN)
  Core: ISRALVVTH
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXSRXLXVTXTYLEP

SEQ ID NO: 338875 - protein, 16 aa, Artificial Sequence
  Description of Artificial Sequence: Synthetic peptide
  Seed: TLISRALVVTHTYLEP (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEP

SEQ ID NO: 338876 - protein, 16 aa, Artificial Sequence
  Description of Artificial Sequence: Synthetic peptide
  Seed: TLISRALVVTHTYLEP (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXLEP

SEQ ID NO: 338877 - protein, 16 aa, Artificial Sequence
  Description of Artificial Sequence: Synthetic peptide
  Seed: TLISRALVVTHTYLEP (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXP

SEQ ID NO: 338878 - protein, 16 aa, Artificial Sequence
  Description of Artificial Sequence: Synthetic peptide
  Seed: TLISRALVVTHTYLEP (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEX

SEQ ID NO: 338879 - protein, 17 aa, Artificial Sequence
  Description of Artificial Sequence: Synthetic peptide
  Seed: TLISRALVVTHTYLEPG (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPG

SEQ ID NO: 338880 - protein, 17 aa, Artificial Sequence
  Description of Artificial Sequence: Synthetic peptide
  Seed: TLISRALVVTHTYLEPG (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXLEPG

SEQ ID NO: 338881 - protein, 17 aa, Artificial Sequence
  Description of Artificial Sequence: Synthetic peptide
  Seed: TLISRALVVTHTYLEPG (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPG

SEQ ID NO: 338882 - protein, 17 aa, Artificial Sequence
  Description of Artificial Sequence: Synthetic peptide
  Seed: TLISRALVVTHTYLEPG (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXG

SEQ ID NO: 338883 - protein, 17 aa, Artificial Sequence
  Description of Artificial Sequence: Synthetic peptide
  Seed: TLISRALVVTHTYLEPG (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPX

SEQ ID NO: 338884 - protein, 18 aa, Artificial Sequence
  Description of Artificial Sequence: Synthetic peptide
  Seed: TLISRALVVTHTYLEPGP (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGP

SEQ ID NO: 338885 - protein, 18 aa, Artificial Sequence
  Description of Artificial Sequence: Synthetic peptide
  Seed: TLISRALVVTHTYLEPGP (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGP

SEQ ID NO: 338886 - protein, 18 aa, Artificial Sequence
  Description of Artificial Sequence: Synthetic peptide
  Seed: TLISRALVVTHTYLEPGP (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXP

SEQ ID NO: 338887 - protein, 19 aa, Artificial Sequence
  Description of Artificial Sequence: Synthetic peptide
  Seed: TLISRALVVTHTYLEPGPV (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPV

SEQ ID NO: 338888 - protein, 19 aa, Artificial Sequence
  Description of Artificial Sequence: Synthetic peptide
  Seed: TLISRALVVTHTYLEPGPV (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXLEPGPV

SEQ ID NO: 338889 - protein, 19 aa, Artificial Sequence
  Description of Artificial Sequence: Synthetic peptide
  Seed: TLISRALVVTHTYLEPGPV (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPV

SEQ ID NO: 338890 - protein, 19 aa, Artificial Sequence
  Description of Artificial Sequence: Synthetic peptide
  Seed: TLISRALVVTHTYLEPGPV (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPV

SEQ ID NO: 338891 - protein, 19 aa, Artificial Sequence
  Description of Artificial Sequence: Synthetic peptide
  Seed: TLISRALVVTHTYLEPGPV (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPV

SEQ ID NO: 338892 - protein, 20 aa, Artificial Sequence
  Description of Artificial Sequence: Synthetic peptide
  Seed: TLISRALVVTHTYLEPGPVT (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVT

SEQ ID NO: 338893 - protein, 20 aa, Artificial Sequence
  Description of Artificial Sequence: Synthetic peptide
  Seed: TLISRALVVTHTYLEPGPVT (PMEL_HUMAN)
  Core: RALVVTHTY
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLISXALXVXHTXLEPGPVT

SEQ ID NO: 338894 - protein, 20 aa, Artificial Sequence
  Description of Artificial Sequence: Synthetic peptide
  Seed: TLISRALVVTHTYLEPGPVT (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVT

SEQ ID NO: 338895 - protein, 20 aa, Artificial Sequence
  Description of Artificial Sequence: Synthetic peptide
  Seed: TLISRALVVTHTYLEPGPVT (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVT

SEQ ID NO: 338896 - protein, 20 aa, Artificial Sequence
  Description of Artificial Sequence: Synthetic peptide
  Seed: TLISRALVVTHTYLEPGPVT (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVT

SEQ ID NO: 338897 - protein, 21 aa, Artificial Sequence
  Description of Artificial Sequence: Synthetic peptide
  Seed: TLISRALVVTHTYLEPGPVTA (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVTA

SEQ ID NO: 338898 - protein, 21 aa, Artificial Sequence
  Description of Artificial Sequence: Synthetic peptide
  Seed: TLISRALVVTHTYLEPGPVTA (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVTA

SEQ ID NO: 338899 - protein, 21 aa, Artificial Sequence
  Description of Artificial Sequence: Synthetic peptide
  Seed: TLISRALVVTHTYLEPGPVTA (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVTA

SEQ ID NO: 338900 - protein, 21 aa, Artificial Sequence
  Description of Artificial Sequence: Synthetic peptide
  Seed: TLISRALVVTHTYLEPGPVTA (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVTA

SEQ ID NO: 338901 - protein, 22 aa, Artificial Sequence
  Description of Artificial Sequence: Synthetic peptide
  Seed: TLISRALVVTHTYLEPGPVTAQ (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVTAQ

SEQ ID NO: 338902 - protein, 22 aa, Artificial Sequence
  Description of Artificial Sequence: Synthetic peptide
  Seed: TLISRALVVTHTYLEPGPVTAQ (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVTAQ

SEQ ID NO: 338903 - protein, 22 aa, Artificial Sequence
  Description of Artificial Sequence: Synthetic peptide
  Seed: TLISRALVVTHTYLEPGPVTAQ (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVTAQ

SEQ ID NO: 338904 - protein, 22 aa, Artificial Sequence
  Description of Artificial Sequence: Synthetic peptide
  Seed: TLISRALVVTHTYLEPGPVTAQ (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVTAQ

SEQ ID NO: 338905 - protein, 22 aa, Artificial Sequence
  Description of Artificial Sequence: Synthetic peptide
  Seed: TLISRALVVTHTYLEPGPVTAQ (PMEL_HUMAN)
  Core: HTYLEPGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVVTXTYXEXGPXTAQ

SEQ ID NO: 338906 - protein, 23 aa, Artificial Sequence
  Description of Artificial Sequence: Synthetic peptide
  Seed: TLISRALVVTHTYLEPGPVTAQV (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVTAQV

SEQ ID NO: 338907 - protein, 23 aa, Artificial Sequence
  Description of Artificial Sequence: Synthetic peptide
  Seed: TLISRALVVTHTYLEPGPVTAQV (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVTAQV

SEQ ID NO: 338908 - protein, 23 aa, Artificial Sequence
  Description of Artificial Sequence: Synthetic peptide
  Seed: TLISRALVVTHTYLEPGPVTAQV (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVTAQV

SEQ ID NO: 338909 - protein, 23 aa, Artificial Sequence
  Description of Artificial Sequence: Synthetic peptide
  Seed: TLISRALVVTHTYLEPGPVTAQV (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVTAQV

SEQ ID NO: 338910 - protein, 23 aa, Artificial Sequence
  Description of Artificial Sequence: Synthetic peptide
  Seed: TLISRALVVTHTYLEPGPVTAQV (PMEL_HUMAN)
  Core: HTYLEPGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVVTXTYXEXGPXTAQV

SEQ ID NO: 338911 - protein, 24 aa, Artificial Sequence
  Description of Artificial Sequence: Synthetic peptide
  Seed: TLISRALVVTHTYLEPGPVTAQVV (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVTAQVV

SEQ ID NO: 338912 - protein, 24 aa, Artificial Sequence
  Description of Artificial Sequence: Synthetic peptide
  Seed: TLISRALVVTHTYLEPGPVTAQVV (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVTAQVV

SEQ ID NO: 338913 - protein, 24 aa, Artificial Sequence
  Description of Artificial Sequence: Synthetic peptide
  Seed: TLISRALVVTHTYLEPGPVTAQVV (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVTAQVV

SEQ ID NO: 338914 - protein, 24 aa, Artificial Sequence
  Description of Artificial Sequence: Synthetic peptide
  Seed: TLISRALVVTHTYLEPGPVTAQVV (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVTAQVV

SEQ ID NO: 338915 - protein, 24 aa, Artificial Sequence
  Description of Artificial Sequence: Synthetic peptide
  Seed: TLISRALVVTHTYLEPGPVTAQVV (PMEL_HUMAN)
  Core: HTYLEPGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVVTXTYXEXGPXTAQVV

SEQ ID NO: 338916 - protein, 25 aa, Artificial Sequence
  Description of Artificial Sequence: Synthetic peptide
  Seed: TLISRALVVTHTYLEPGPVTAQVVL (PMEL_HUMAN)
  Core: SRALVVTHT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLIXRAXVXTHXYLEPGPVTAQVVL

SEQ ID NO: 338917 - protein, 25 aa, Artificial Sequence
  Description of Artificial Sequence: Synthetic peptide
  Seed: TLISRALVVTHTYLEPGPVTAQVVL (PMEL_HUMAN)
  Core: LVVTHTYLE
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLISRAXVVXHXYLXPGPVTAQVVL

SEQ ID NO: 338918 - protein, 25 aa, Artificial Sequence
  Description of Artificial Sequence: Synthetic peptide
  Seed: TLISRALVVTHTYLEPGPVTAQVVL (PMEL_HUMAN)
  Core: VVTHTYLEP
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALXVTXTXLEXGPVTAQVVL

SEQ ID NO: 338919 - protein, 25 aa, Artificial Sequence
  Description of Artificial Sequence: Synthetic peptide
  Seed: TLISRALVVTHTYLEPGPVTAQVVL (PMEL_HUMAN)
  Core: VTHTYLEPG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVXTHXYXEPXPVTAQVVL

SEQ ID NO: 338920 - protein, 25 aa, Artificial Sequence
  Description of Artificial Sequence: Synthetic peptide
  Seed: TLISRALVVTHTYLEPGPVTAQVVL (PMEL_HUMAN)
  Core: HTYLEPGPV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLISRALVVTXTYXEXGPXTAQVVL

SEQ ID NO: 338921 - protein, 13 aa, Artificial Sequence
  Description of Artificial Sequence: Synthetic peptide
  Seed: TLRLVKRQVPLDC (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDC

SEQ ID NO: 338922 - protein, 13 aa, Artificial Sequence
  Description of Artificial Sequence: Synthetic peptide
  Seed: TLRLVKRQVPLDC (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXC

SEQ ID NO: 338923 - protein, 14 aa, Artificial Sequence
  Description of Artificial Sequence: Synthetic peptide
  Seed: TLRLVKRQVPLDCV (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCV

SEQ ID NO: 338924 - protein, 14 aa, Artificial Sequence
  Description of Artificial Sequence: Synthetic peptide
  Seed: TLRLVKRQVPLDCV (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCV

SEQ ID NO: 338925 - protein, 15 aa, Artificial Sequence
  Description of Artificial Sequence: Synthetic peptide
  Seed: TLRLVKRQVPLDCVL (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVL

SEQ ID NO: 338926 - protein, 15 aa, Artificial Sequence
  Description of Artificial Sequence: Synthetic peptide
  Seed: TLRLVKRQVPLDCVL (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVL

SEQ ID NO: 338927 - protein, 15 aa, Artificial Sequence
  Description of Artificial Sequence: Synthetic peptide
  Seed: TLRLVKRQVPLDCVL (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVL

SEQ ID NO: 338928 - protein, 15 aa, Artificial Sequence
  Description of Artificial Sequence: Synthetic peptide
  Seed: TLRLVKRQVPLDCVL (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXL

SEQ ID NO: 338929 - protein, 16 aa, Artificial Sequence
  Description of Artificial Sequence: Synthetic peptide
  Seed: TLRLVKRQVPLDCVLY (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLY

SEQ ID NO: 338930 - protein, 16 aa, Artificial Sequence
  Description of Artificial Sequence: Synthetic peptide
  Seed: TLRLVKRQVPLDCVLY (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLY

SEQ ID NO: 338931 - protein, 16 aa, Artificial Sequence
  Description of Artificial Sequence: Synthetic peptide
  Seed: TLRLVKRQVPLDCVLY (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLY

SEQ ID NO: 338932 - protein, 16 aa, Artificial Sequence
  Description of Artificial Sequence: Synthetic peptide
  Seed: TLRLVKRQVPLDCVLY (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLY

SEQ ID NO: 338933 - protein, 17 aa, Artificial Sequence
  Description of Artificial Sequence: Synthetic peptide
  Seed: TLRLVKRQVPLDCVLYR (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLYR

SEQ ID NO: 338934 - protein, 17 aa, Artificial Sequence
  Description of Artificial Sequence: Synthetic peptide
  Seed: TLRLVKRQVPLDCVLYR (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYR

SEQ ID NO: 338935 - protein, 17 aa, Artificial Sequence
  Description of Artificial Sequence: Synthetic peptide
  Seed: TLRLVKRQVPLDCVLYR (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYR

SEQ ID NO: 338936 - protein, 17 aa, Artificial Sequence
  Description of Artificial Sequence: Synthetic peptide
  Seed: TLRLVKRQVPLDCVLYR (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYR

SEQ ID NO: 338937 - protein, 18 aa, Artificial Sequence
  Description of Artificial Sequence: Synthetic peptide
  Seed: TLRLVKRQVPLDCVLYRY (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRY

SEQ ID NO: 338938 - protein, 18 aa, Artificial Sequence
  Description of Artificial Sequence: Synthetic peptide
  Seed: TLRLVKRQVPLDCVLYRY (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRY

SEQ ID NO: 338939 - protein, 18 aa, Artificial Sequence
  Description of Artificial Sequence: Synthetic peptide
  Seed: TLRLVKRQVPLDCVLYRY (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRY

SEQ ID NO: 338940 - protein, 19 aa, Artificial Sequence
  Description of Artificial Sequence: Synthetic peptide
  Seed: TLRLVKRQVPLDCVLYRYG (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLYRYG

SEQ ID NO: 338941 - protein, 19 aa, Artificial Sequence
  Description of Artificial Sequence: Synthetic peptide
  Seed: TLRLVKRQVPLDCVLYRYG (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYG

SEQ ID NO: 338942 - protein, 19 aa, Artificial Sequence
  Description of Artificial Sequence: Synthetic peptide
  Seed: TLRLVKRQVPLDCVLYRYG (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYG

SEQ ID NO: 338943 - protein, 19 aa, Artificial Sequence
  Description of Artificial Sequence: Synthetic peptide
  Seed: TLRLVKRQVPLDCVLYRYG (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYG

SEQ ID NO: 338944 - protein, 19 aa, Artificial Sequence
  Description of Artificial Sequence: Synthetic peptide
  Seed: TLRLVKRQVPLDCVLYRYG (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYG

SEQ ID NO: 338945 - protein, 19 aa, Artificial Sequence
  Description of Artificial Sequence: Synthetic peptide
  Seed: TLRLVKRQVPLDCVLYRYG (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYG

SEQ ID NO: 338946 - protein, 19 aa, Artificial Sequence
  Description of Artificial Sequence: Synthetic peptide
  Seed: TLRLVKRQVPLDCVLYRYG (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYX

SEQ ID NO: 338947 - protein, 20 aa, Artificial Sequence
  Description of Artificial Sequence: Synthetic peptide
  Seed: TLRLVKRQVPLDCVLYRYGS (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLYRYGS

SEQ ID NO: 338948 - protein, 20 aa, Artificial Sequence
  Description of Artificial Sequence: Synthetic peptide
  Seed: TLRLVKRQVPLDCVLYRYGS (PMEL_HUMAN)
  Core: RLVKRQVPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXLVXRXVPXDCVLYRYGS

SEQ ID NO: 338949 - protein, 20 aa, Artificial Sequence
  Description of Artificial Sequence: Synthetic peptide
  Seed: TLRLVKRQVPLDCVLYRYGS (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGS

SEQ ID NO: 338950 - protein, 20 aa, Artificial Sequence
  Description of Artificial Sequence: Synthetic peptide
  Seed: TLRLVKRQVPLDCVLYRYGS (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGS

SEQ ID NO: 338951 - protein, 20 aa, Artificial Sequence
  Description of Artificial Sequence: Synthetic peptide
  Seed: TLRLVKRQVPLDCVLYRYGS (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGS

SEQ ID NO: 338952 - protein, 20 aa, Artificial Sequence
  Description of Artificial Sequence: Synthetic peptide
  Seed: TLRLVKRQVPLDCVLYRYGS (PMEL_HUMAN)
  Core: RQVPLDCVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKXQVXLXCVXYRYGS

SEQ ID NO: 338953 - protein, 20 aa, Artificial Sequence
  Description of Artificial Sequence: Synthetic peptide
  Seed: TLRLVKRQVPLDCVLYRYGS (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGS

SEQ ID NO: 338954 - protein, 20 aa, Artificial Sequence
  Description of Artificial Sequence: Synthetic peptide
  Seed: TLRLVKRQVPLDCVLYRYGS (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGS

SEQ ID NO: 338955 - protein, 20 aa, Artificial Sequence
  Description of Artificial Sequence: Synthetic peptide
  Seed: TLRLVKRQVPLDCVLYRYGS (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXS

SEQ ID NO: 338956 - protein, 21 aa, Artificial Sequence
  Description of Artificial Sequence: Synthetic peptide
  Seed: TLRLVKRQVPLDCVLYRYGSF (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLYRYGSF

SEQ ID NO: 338957 - protein, 21 aa, Artificial Sequence
  Description of Artificial Sequence: Synthetic peptide
  Seed: TLRLVKRQVPLDCVLYRYGSF (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGSF

SEQ ID NO: 338958 - protein, 21 aa, Artificial Sequence
  Description of Artificial Sequence: Synthetic peptide
  Seed: TLRLVKRQVPLDCVLYRYGSF (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGSF

SEQ ID NO: 338959 - protein, 21 aa, Artificial Sequence
  Description of Artificial Sequence: Synthetic peptide
  Seed: TLRLVKRQVPLDCVLYRYGSF (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGSF

SEQ ID NO: 338960 - protein, 21 aa, Artificial Sequence
  Description of Artificial Sequence: Synthetic peptide
  Seed: TLRLVKRQVPLDCVLYRYGSF (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGSF

SEQ ID NO: 338961 - protein, 21 aa, Artificial Sequence
  Description of Artificial Sequence: Synthetic peptide
  Seed: TLRLVKRQVPLDCVLYRYGSF (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGSF

SEQ ID NO: 338962 - protein, 21 aa, Artificial Sequence
  Description of Artificial Sequence: Synthetic peptide
  Seed: TLRLVKRQVPLDCVLYRYGSF (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXSF

SEQ ID NO: 338963 - protein, 22 aa, Artificial Sequence
  Description of Artificial Sequence: Synthetic peptide
  Seed: TLRLVKRQVPLDCVLYRYGSFS (PMEL_HUMAN)
  Core: LRLVKRQVP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXRLXKXQVXLDCVLYRYGSFS

SEQ ID NO: 338964 - protein, 22 aa, Artificial Sequence
  Description of Artificial Sequence: Synthetic peptide
  Seed: TLRLVKRQVPLDCVLYRYGSFS (PMEL_HUMAN)
  Core: RLVKRQVPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXLVXRXVPXDCVLYRYGSFS

SEQ ID NO: 338965 - protein, 22 aa, Artificial Sequence
  Description of Artificial Sequence: Synthetic peptide
  Seed: TLRLVKRQVPLDCVLYRYGSFS (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGSFS

SEQ ID NO: 338966 - protein, 22 aa, Artificial Sequence
  Description of Artificial Sequence: Synthetic peptide
  Seed: TLRLVKRQVPLDCVLYRYGSFS (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGSFS

SEQ ID NO: 338967 - protein, 22 aa, Artificial Sequence
  Description of Artificial Sequence: Synthetic peptide
  Seed: TLRLVKRQVPLDCVLYRYGSFS (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGSFS

SEQ ID NO: 338968 - protein, 22 aa, Artificial Sequence
  Description of Artificial Sequence: Synthetic peptide
  Seed: TLRLVKRQVPLDCVLYRYGSFS (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGSFS

SEQ ID NO: 338969 - protein, 22 aa, Artificial Sequence
  Description of Artificial Sequence: Synthetic peptide
  Seed: TLRLVKRQVPLDCVLYRYGSFS (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGSFS

SEQ ID NO: 338970 - protein, 22 aa, Artificial Sequence
  Description of Artificial Sequence: Synthetic peptide
  Seed: TLRLVKRQVPLDCVLYRYGSFS (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXSFS

SEQ ID NO: 338971 - protein, 23 aa, Artificial Sequence
  Description of Artificial Sequence: Synthetic peptide
  Seed: TLRLVKRQVPLDCVLYRYGSFSV (PMEL_HUMAN)
  Core: RLVKRQVPL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TLXLVXRXVPXDCVLYRYGSFSV

SEQ ID NO: 338972 - protein, 23 aa, Artificial Sequence
  Description of Artificial Sequence: Synthetic peptide
  Seed: TLRLVKRQVPLDCVLYRYGSFSV (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGSFSV

SEQ ID NO: 338973 - protein, 23 aa, Artificial Sequence
  Description of Artificial Sequence: Synthetic peptide
  Seed: TLRLVKRQVPLDCVLYRYGSFSV (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGSFSV

SEQ ID NO: 338974 - protein, 23 aa, Artificial Sequence
  Description of Artificial Sequence: Synthetic peptide
  Seed: TLRLVKRQVPLDCVLYRYGSFSV (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGSFSV

SEQ ID NO: 338975 - protein, 23 aa, Artificial Sequence
  Description of Artificial Sequence: Synthetic peptide
  Seed: TLRLVKRQVPLDCVLYRYGSFSV (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGSFSV

SEQ ID NO: 338976 - protein, 23 aa, Artificial Sequence
  Description of Artificial Sequence: Synthetic peptide
  Seed: TLRLVKRQVPLDCVLYRYGSFSV (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGSFSV

SEQ ID NO: 338977 - protein, 23 aa, Artificial Sequence
  Description of Artificial Sequence: Synthetic peptide
  Seed: TLRLVKRQVPLDCVLYRYGSFSV (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXSFSV

SEQ ID NO: 338978 - protein, 23 aa, Artificial Sequence
  Description of Artificial Sequence: Synthetic peptide
  Seed: TLRLVKRQVPLDCVLYRYGSFSV (PMEL_HUMAN)
  Core: LYRYGSFSV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDCVXYRXGXFSX

SEQ ID NO: 338979 - protein, 24 aa, Artificial Sequence
  Description of Artificial Sequence: Synthetic peptide
  Seed: TLRLVKRQVPLDCVLYRYGSFSVT (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGSFSVT

SEQ ID NO: 338980 - protein, 24 aa, Artificial Sequence
  Description of Artificial Sequence: Synthetic peptide
  Seed: TLRLVKRQVPLDCVLYRYGSFSVT (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGSFSVT

SEQ ID NO: 338981 - protein, 24 aa, Artificial Sequence
  Description of Artificial Sequence: Synthetic peptide
  Seed: TLRLVKRQVPLDCVLYRYGSFSVT (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGSFSVT

SEQ ID NO: 338982 - protein, 24 aa, Artificial Sequence
  Description of Artificial Sequence: Synthetic peptide
  Seed: TLRLVKRQVPLDCVLYRYGSFSVT (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGSFSVT

SEQ ID NO: 338983 - protein, 24 aa, Artificial Sequence
  Description of Artificial Sequence: Synthetic peptide
  Seed: TLRLVKRQVPLDCVLYRYGSFSVT (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGSFSVT

SEQ ID NO: 338984 - protein, 24 aa, Artificial Sequence
  Description of Artificial Sequence: Synthetic peptide
  Seed: TLRLVKRQVPLDCVLYRYGSFSVT (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXSFSVT

SEQ ID NO: 338985 - protein, 24 aa, Artificial Sequence
  Description of Artificial Sequence: Synthetic peptide
  Seed: TLRLVKRQVPLDCVLYRYGSFSVT (PMEL_HUMAN)
  Core: LYRYGSFSV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDCVXYRXGXFSXT

SEQ ID NO: 338986 - protein, 24 aa, Artificial Sequence
  Description of Artificial Sequence: Synthetic peptide
  Seed: TLRLVKRQVPLDCVLYRYGSFSVT (PMEL_HUMAN)
  Core: YRYGSFSVT
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDCVLXRYXSXSVX

SEQ ID NO: 338987 - protein, 25 aa, Artificial Sequence
  Description of Artificial Sequence: Synthetic peptide
  Seed: TLRLVKRQVPLDCVLYRYGSFSVTL (PMEL_HUMAN)
  Core: LVKRQVPLD
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TLRXVKXQXPLXCVLYRYGSFSVTL

SEQ ID NO: 338988 - protein, 25 aa, Artificial Sequence
  Description of Artificial Sequence: Synthetic peptide
  Seed: TLRLVKRQVPLDCVLYRYGSFSVTL (PMEL_HUMAN)
  Core: VKRQVPLDC
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TLRLXKRXVXLDXVLYRYGSFSVTL

SEQ ID NO: 338989 - protein, 25 aa, Artificial Sequence
  Description of Artificial Sequence: Synthetic peptide
  Seed: TLRLVKRQVPLDCVLYRYGSFSVTL (PMEL_HUMAN)
  Core: KRQVPLDCV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVXRQXPXDCXLYRYGSFSVTL

SEQ ID NO: 338990 - protein, 25 aa, Artificial Sequence
  Description of Artificial Sequence: Synthetic peptide
  Seed: TLRLVKRQVPLDCVLYRYGSFSVTL (PMEL_HUMAN)
  Core: RQVPLDCVL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKXQVXLXCVXYRYGSFSVTL

SEQ ID NO: 338991 - protein, 25 aa, Artificial Sequence
  Description of Artificial Sequence: Synthetic peptide
  Seed: TLRLVKRQVPLDCVLYRYGSFSVTL (PMEL_HUMAN)
  Core: QVPLDCVLY
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRXVPXDXVLXRYGSFSVTL

SEQ ID NO: 338992 - protein, 25 aa, Artificial Sequence
  Description of Artificial Sequence: Synthetic peptide
  Seed: TLRLVKRQVPLDCVLYRYGSFSVTL (PMEL_HUMAN)
  Core: VPLDCVLYR
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQXPLXCXLYXYGSFSVTL

SEQ ID NO: 338993 - protein, 25 aa, Artificial Sequence
  Description of Artificial Sequence: Synthetic peptide
  Seed: TLRLVKRQVPLDCVLYRYGSFSVTL (PMEL_HUMAN)
  Core: LDCVLYRYG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPXDCXLXRYXSFSVTL

SEQ ID NO: 338994 - protein, 25 aa, Artificial Sequence
  Description of Artificial Sequence: Synthetic peptide
  Seed: TLRLVKRQVPLDCVLYRYGSFSVTL (PMEL_HUMAN)
  Core: DCVLYRYGS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLXCVXYXYGXFSVTL

SEQ ID NO: 338995 - protein, 25 aa, Artificial Sequence
  Description of Artificial Sequence: Synthetic peptide
  Seed: TLRLVKRQVPLDCVLYRYGSFSVTL (PMEL_HUMAN)
  Core: CVLYRYGSF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDXVLXRXGSXSVTL

SEQ ID NO: 338996 - protein, 25 aa, Artificial Sequence
  Description of Artificial Sequence: Synthetic peptide
  Seed: TLRLVKRQVPLDCVLYRYGSFSVTL (PMEL_HUMAN)
  Core: LYRYGSFSV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDCVXYRXGXFSXTL

SEQ ID NO: 338997 - protein, 25 aa, Artificial Sequence
  Description of Artificial Sequence: Synthetic peptide
  Seed: TLRLVKRQVPLDCVLYRYGSFSVTL (PMEL_HUMAN)
  Core: YRYGSFSVT
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TLRLVKRQVPLDCVLXRYXSXSVXL

SEQ ID NO: 338998 - protein, 13 aa, Artificial Sequence
  Description of Artificial Sequence: Synthetic peptide
  Seed: TMEVTVYHRRGSR (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXR

SEQ ID NO: 338999 - protein, 14 aa, Artificial Sequence
  Description of Artificial Sequence: Synthetic peptide
  Seed: TMEVTVYHRRGSRS (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRS

SEQ ID NO: 339000 - protein, 15 aa, Artificial Sequence
  Description of Artificial Sequence: Synthetic peptide
  Seed: TMEVTVYHRRGSRSY (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSY

SEQ ID NO: 339001 - protein, 16 aa, Artificial Sequence
  Description of Artificial Sequence: Synthetic peptide
  Seed: TMEVTVYHRRGSRSYV (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYV

SEQ ID NO: 339002 - protein, 17 aa, Artificial Sequence
  Description of Artificial Sequence: Synthetic peptide
  Seed: TMEVTVYHRRGSRSYVP (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVP

SEQ ID NO: 339003 - protein, 18 aa, Artificial Sequence
  Description of Artificial Sequence: Synthetic peptide
  Seed: TMEVTVYHRRGSRSYVPL (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPL

SEQ ID NO: 339004 - protein, 19 aa, Artificial Sequence
  Description of Artificial Sequence: Synthetic peptide
  Seed: TMEVTVYHRRGSRSYVPLA (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLA

SEQ ID NO: 339005 - protein, 20 aa, Artificial Sequence
  Description of Artificial Sequence: Synthetic peptide
  Seed: TMEVTVYHRRGSRSYVPLAH (PMEL_HUMAN)
  Core: MEVTVYHRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXEVXVXHRXGSRSYVPLAH

SEQ ID NO: 339006 - protein, 20 aa, Artificial Sequence
  Description of Artificial Sequence: Synthetic peptide
  Seed: TMEVTVYHRRGSRSYVPLAH (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAH

SEQ ID NO: 339007 - protein, 20 aa, Artificial Sequence
  Description of Artificial Sequence: Synthetic peptide
  Seed: TMEVTVYHRRGSRSYVPLAH (PMEL_HUMAN)
  Core: VYHRRGSRS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTXYHXRXSRXYVPLAH

SEQ ID NO: 339008 - protein, 20 aa, Artificial Sequence
  Description of Artificial Sequence: Synthetic peptide
  Seed: TMEVTVYHRRGSRSYVPLAH (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAH

SEQ ID NO: 339009 - protein, 20 aa, Artificial Sequence
  Description of Artificial Sequence: Synthetic peptide
  Seed: TMEVTVYHRRGSRSYVPLAH (PMEL_HUMAN)
  Core: RRGSRSYVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHXRGXRXYVXLAH

SEQ ID NO: 339010 - protein, 20 aa, Artificial Sequence
  Description of Artificial Sequence: Synthetic peptide
  Seed: TMEVTVYHRRGSRSYVPLAH (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXH

SEQ ID NO: 339011 - protein, 21 aa, Artificial Sequence
  Description of Artificial Sequence: Synthetic peptide
  Seed: TMEVTVYHRRGSRSYVPLAHS (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAHS

SEQ ID NO: 339012 - protein, 21 aa, Artificial Sequence
  Description of Artificial Sequence: Synthetic peptide
  Seed: TMEVTVYHRRGSRSYVPLAHS (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAHS

SEQ ID NO: 339013 - protein, 21 aa, Artificial Sequence
  Description of Artificial Sequence: Synthetic peptide
  Seed: TMEVTVYHRRGSRSYVPLAHS (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXHS

SEQ ID NO: 339014 - protein, 21 aa, Artificial Sequence
  Description of Artificial Sequence: Synthetic peptide
  Seed: TMEVTVYHRRGSRSYVPLAHS (PMEL_HUMAN)
  Core: SRSYVPLAH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGXRSXVXLAXS

SEQ ID NO: 339015 - protein, 21 aa, Artificial Sequence
  Description of Artificial Sequence: Synthetic peptide
  Seed: TMEVTVYHRRGSRSYVPLAHS (PMEL_HUMAN)
  Core: RSYVPLAHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSXSYXPXAHX

SEQ ID NO: 339016 - protein, 22 aa, Artificial Sequence
  Description of Artificial Sequence: Synthetic peptide
  Seed: TMEVTVYHRRGSRSYVPLAHSS (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAHSS

SEQ ID NO: 339017 - protein, 22 aa, Artificial Sequence
  Description of Artificial Sequence: Synthetic peptide
  Seed: TMEVTVYHRRGSRSYVPLAHSS (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAHSS

SEQ ID NO: 339018 - protein, 22 aa, Artificial Sequence
  Description of Artificial Sequence: Synthetic peptide
  Seed: TMEVTVYHRRGSRSYVPLAHSS (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXHSS

SEQ ID NO: 339019 - protein, 22 aa, Artificial Sequence
  Description of Artificial Sequence: Synthetic peptide
  Seed: TMEVTVYHRRGSRSYVPLAHSS (PMEL_HUMAN)
  Core: SRSYVPLAH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGXRSXVXLAXSS

SEQ ID NO: 339020 - protein, 22 aa, Artificial Sequence
  Description of Artificial Sequence: Synthetic peptide
  Seed: TMEVTVYHRRGSRSYVPLAHSS (PMEL_HUMAN)
  Core: RSYVPLAHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSXSYXPXAHXS

SEQ ID NO: 339021 - protein, 23 aa, Artificial Sequence
  Description of Artificial Sequence: Synthetic peptide
  Seed: TMEVTVYHRRGSRSYVPLAHSSS (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAHSSS

SEQ ID NO: 339022 - protein, 23 aa, Artificial Sequence
  Description of Artificial Sequence: Synthetic peptide
  Seed: TMEVTVYHRRGSRSYVPLAHSSS (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAHSSS

SEQ ID NO: 339023 - protein, 23 aa, Artificial Sequence
  Description of Artificial Sequence: Synthetic peptide
  Seed: TMEVTVYHRRGSRSYVPLAHSSS (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXHSSS

SEQ ID NO: 339024 - protein, 23 aa, Artificial Sequence
  Description of Artificial Sequence: Synthetic peptide
  Seed: TMEVTVYHRRGSRSYVPLAHSSS (PMEL_HUMAN)
  Core: SRSYVPLAH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGXRSXVXLAXSSS

SEQ ID NO: 339025 - protein, 23 aa, Artificial Sequence
  Description of Artificial Sequence: Synthetic peptide
  Seed: TMEVTVYHRRGSRSYVPLAHSSS (PMEL_HUMAN)
  Core: RSYVPLAHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSXSYXPXAHXSS

SEQ ID NO: 339026 - protein, 23 aa, Artificial Sequence
  Description of Artificial Sequence: Synthetic peptide
  Seed: TMEVTVYHRRGSRSYVPLAHSSS (PMEL_HUMAN)
  Core: YVPLAHSSS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSRSXVPXAXSSX

SEQ ID NO: 339027 - protein, 24 aa, Artificial Sequence
  Description of Artificial Sequence: Synthetic peptide
  Seed: TMEVTVYHRRGSRSYVPLAHSSSA (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAHSSSA

SEQ ID NO: 339028 - protein, 24 aa, Artificial Sequence
  Description of Artificial Sequence: Synthetic peptide
  Seed: TMEVTVYHRRGSRSYVPLAHSSSA (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAHSSSA

SEQ ID NO: 339029 - protein, 24 aa, Artificial Sequence
  Description of Artificial Sequence: Synthetic peptide
  Seed: TMEVTVYHRRGSRSYVPLAHSSSA (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXHSSSA

SEQ ID NO: 339030 - protein, 24 aa, Artificial Sequence
  Description of Artificial Sequence: Synthetic peptide
  Seed: TMEVTVYHRRGSRSYVPLAHSSSA (PMEL_HUMAN)
  Core: SRSYVPLAH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGXRSXVXLAXSSSA

SEQ ID NO: 339031 - protein, 24 aa, Artificial Sequence
  Description of Artificial Sequence: Synthetic peptide
  Seed: TMEVTVYHRRGSRSYVPLAHSSSA (PMEL_HUMAN)
  Core: RSYVPLAHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSXSYXPXAHXSSA

SEQ ID NO: 339032 - protein, 24 aa, Artificial Sequence
  Description of Artificial Sequence: Synthetic peptide
  Seed: TMEVTVYHRRGSRSYVPLAHSSSA (PMEL_HUMAN)
  Core: YVPLAHSSS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSRSXVPXAXSSXA

SEQ ID NO: 339033 - protein, 25 aa, Artificial Sequence
  Description of Artificial Sequence: Synthetic peptide
  Seed: TMEVTVYHRRGSRSYVPLAHSSSAF (PMEL_HUMAN)
  Core: VTVYHRRGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TMEXTVXHXRGXRSYVPLAHSSSAF

SEQ ID NO: 339034 - protein, 25 aa, Artificial Sequence
  Description of Artificial Sequence: Synthetic peptide
  Seed: TMEVTVYHRRGSRSYVPLAHSSSAF (PMEL_HUMAN)
  Core: YHRRGSRSY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVXHRXGXRSXVPLAHSSSAF

SEQ ID NO: 339035 - protein, 25 aa, Artificial Sequence
  Description of Artificial Sequence: Synthetic peptide
  Seed: TMEVTVYHRRGSRSYVPLAHSSSAF (PMEL_HUMAN)
  Core: GSRSYVPLA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRXSRXYXPLXHSSSAF

SEQ ID NO: 339036 - protein, 25 aa, Artificial Sequence
  Description of Artificial Sequence: Synthetic peptide
  Seed: TMEVTVYHRRGSRSYVPLAHSSSAF (PMEL_HUMAN)
  Core: SRSYVPLAH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGXRSXVXLAXSSSAF

SEQ ID NO: 339037 - protein, 25 aa, Artificial Sequence
  Description of Artificial Sequence: Synthetic peptide
  Seed: TMEVTVYHRRGSRSYVPLAHSSSAF (PMEL_HUMAN)
  Core: RSYVPLAHS
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSXSYXPXAHXSSAF

SEQ ID NO: 339038 - protein, 25 aa, Artificial Sequence
  Description of Artificial Sequence: Synthetic peptide
  Seed: TMEVTVYHRRGSRSYVPLAHSSSAF (PMEL_HUMAN)
  Core: YVPLAHSSS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TMEVTVYHRRGSRSXVPXAXSSXAF

SEQ ID NO: 339039 - protein, 13 aa, Artificial Sequence
  Description of Artificial Sequence: Synthetic peptide
  Seed: TNSLAVVSTQLIM (PMEL_HUMAN)
  Core: NSLAVVSTQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXSLXVXSTXLIM

SEQ ID NO: 339040 - protein, 13 aa, Artificial Sequence
  Description of Artificial Sequence: Synthetic peptide
  Seed: TNSLAVVSTQLIM (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXM

SEQ ID NO: 339041 - protein, 14 aa, Artificial Sequence
  Description of Artificial Sequence: Synthetic peptide
  Seed: TNSLAVVSTQLIMP (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMP

SEQ ID NO: 339042 - protein, 15 aa, Artificial Sequence
  Description of Artificial Sequence: Synthetic peptide
  Seed: TNSLAVVSTQLIMPG (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPG

SEQ ID NO: 339043 - protein, 16 aa, Artificial Sequence
  Description of Artificial Sequence: Synthetic peptide
  Seed: TNSLAVVSTQLIMPGQ (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQ

SEQ ID NO: 339044 - protein, 16 aa, Artificial Sequence
  Description of Artificial Sequence: Synthetic peptide
  Seed: TNSLAVVSTQLIMPGQ (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQ

SEQ ID NO: 339045 - protein, 16 aa, Artificial Sequence
  Description of Artificial Sequence: Synthetic peptide
  Seed: TNSLAVVSTQLIMPGQ (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQ

SEQ ID NO: 339046 - protein, 17 aa, Artificial Sequence
  Description of Artificial Sequence: Synthetic peptide
  Seed: TNSLAVVSTQLIMPGQE (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQE

SEQ ID NO: 339047 - protein, 17 aa, Artificial Sequence
  Description of Artificial Sequence: Synthetic peptide
  Seed: TNSLAVVSTQLIMPGQE (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQE

SEQ ID NO: 339048 - protein, 17 aa, Artificial Sequence
  Description of Artificial Sequence: Synthetic peptide
  Seed: TNSLAVVSTQLIMPGQE (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQE

SEQ ID NO: 339049 - protein, 18 aa, Artificial Sequence
  Description of Artificial Sequence: Synthetic peptide
  Seed: TNSLAVVSTQLIMPGQEA (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEA

SEQ ID NO: 339050 - protein, 18 aa, Artificial Sequence
  Description of Artificial Sequence: Synthetic peptide
  Seed: TNSLAVVSTQLIMPGQEA (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEA

SEQ ID NO: 339051 - protein, 18 aa, Artificial Sequence
  Description of Artificial Sequence: Synthetic peptide
  Seed: TNSLAVVSTQLIMPGQEA (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEA

SEQ ID NO: 339052 - protein, 19 aa, Artificial Sequence
  Description of Artificial Sequence: Synthetic peptide
  Seed: TNSLAVVSTQLIMPGQEAG (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAG

SEQ ID NO: 339053 - protein, 19 aa, Artificial Sequence
  Description of Artificial Sequence: Synthetic peptide
  Seed: TNSLAVVSTQLIMPGQEAG (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAG

SEQ ID NO: 339054 - protein, 19 aa, Artificial Sequence
  Description of Artificial Sequence: Synthetic peptide
  Seed: TNSLAVVSTQLIMPGQEAG (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAG

SEQ ID NO: 339055 - protein, 19 aa, Artificial Sequence
  Description of Artificial Sequence: Synthetic peptide
  Seed: TNSLAVVSTQLIMPGQEAG (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXG

SEQ ID NO: 339056 - protein, 20 aa, Artificial Sequence
  Description of Artificial Sequence: Synthetic peptide
  Seed: TNSLAVVSTQLIMPGQEAGL (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGL

SEQ ID NO: 339057 - protein, 20 aa, Artificial Sequence
  Description of Artificial Sequence: Synthetic peptide
  Seed: TNSLAVVSTQLIMPGQEAGL (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGL

SEQ ID NO: 339058 - protein, 20 aa, Artificial Sequence
  Description of Artificial Sequence: Synthetic peptide
  Seed: TNSLAVVSTQLIMPGQEAGL (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAGL

SEQ ID NO: 339059 - protein, 20 aa, Artificial Sequence
  Description of Artificial Sequence: Synthetic peptide
  Seed: TNSLAVVSTQLIMPGQEAGL (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGL

SEQ ID NO: 339060 - protein, 21 aa, Artificial Sequence
  Description of Artificial Sequence: Synthetic peptide
  Seed: TNSLAVVSTQLIMPGQEAGLG (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGLG

SEQ ID NO: 339061 - protein, 21 aa, Artificial Sequence
  Description of Artificial Sequence: Synthetic peptide
  Seed: TNSLAVVSTQLIMPGQEAGLG (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGLG

SEQ ID NO: 339062 - protein, 21 aa, Artificial Sequence
  Description of Artificial Sequence: Synthetic peptide
  Seed: TNSLAVVSTQLIMPGQEAGLG (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGLG

SEQ ID NO: 339063 - protein, 22 aa, Artificial Sequence
  Description of Artificial Sequence: Synthetic peptide
  Seed: TNSLAVVSTQLIMPGQEAGLGQ (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGLGQ

SEQ ID NO: 339064 - protein, 22 aa, Artificial Sequence
  Description of Artificial Sequence: Synthetic peptide
  Seed: TNSLAVVSTQLIMPGQEAGLGQ (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGLGQ

SEQ ID NO: 339065 - protein, 22 aa, Artificial Sequence
  Description of Artificial Sequence: Synthetic peptide
  Seed: TNSLAVVSTQLIMPGQEAGLGQ (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAGLGQ

SEQ ID NO: 339066 - protein, 22 aa, Artificial Sequence
  Description of Artificial Sequence: Synthetic peptide
  Seed: TNSLAVVSTQLIMPGQEAGLGQ (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGLGQ

SEQ ID NO: 339067 - protein, 23 aa, Artificial Sequence
  Description of Artificial Sequence: Synthetic peptide
  Seed: TNSLAVVSTQLIMPGQEAGLGQV (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGLGQV

SEQ ID NO: 339068 - protein, 23 aa, Artificial Sequence
  Description of Artificial Sequence: Synthetic peptide
  Seed: TNSLAVVSTQLIMPGQEAGLGQV (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGLGQV

SEQ ID NO: 339069 - protein, 23 aa, Artificial Sequence
  Description of Artificial Sequence: Synthetic peptide
  Seed: TNSLAVVSTQLIMPGQEAGLGQV (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAGLGQV

SEQ ID NO: 339070 - protein, 23 aa, Artificial Sequence
  Description of Artificial Sequence: Synthetic peptide
  Seed: TNSLAVVSTQLIMPGQEAGLGQV (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGLGQV

SEQ ID NO: 339071 - protein, 23 aa, Artificial Sequence
  Description of Artificial Sequence: Synthetic peptide
  Seed: TNSLAVVSTQLIMPGQEAGLGQV (PMEL_HUMAN)
  Core: IMPGQEAGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTQLXMPXQXAGXGQV

SEQ ID NO: 339072 - protein, 24 aa, Artificial Sequence
  Description of Artificial Sequence: Synthetic peptide
  Seed: TNSLAVVSTQLIMPGQEAGLGQVP (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGLGQVP

SEQ ID NO: 339073 - protein, 24 aa, Artificial Sequence
  Description of Artificial Sequence: Synthetic peptide
  Seed: TNSLAVVSTQLIMPGQEAGLGQVP (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGLGQVP

SEQ ID NO: 339074 - protein, 24 aa, Artificial Sequence
  Description of Artificial Sequence: Synthetic peptide
  Seed: TNSLAVVSTQLIMPGQEAGLGQVP (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAGLGQVP

SEQ ID NO: 339075 - protein, 24 aa, Artificial Sequence
  Description of Artificial Sequence: Synthetic peptide
  Seed: TNSLAVVSTQLIMPGQEAGLGQVP (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGLGQVP

SEQ ID NO: 339076 - protein, 24 aa, Artificial Sequence
  Description of Artificial Sequence: Synthetic peptide
  Seed: TNSLAVVSTQLIMPGQEAGLGQVP (PMEL_HUMAN)
  Core: IMPGQEAGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTQLXMPXQXAGXGQVP

SEQ ID NO: 339077 - protein, 25 aa, Artificial Sequence
  Description of Artificial Sequence: Synthetic peptide
  Seed: TNSLAVVSTQLIMPGQEAGLGQVPL (PMEL_HUMAN)
  Core: LAVVSTQLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TNSXAVXSXQLXMPGQEAGLGQVPL

SEQ ID NO: 339078 - protein, 25 aa, Artificial Sequence
  Description of Artificial Sequence: Synthetic peptide
  Seed: TNSLAVVSTQLIMPGQEAGLGQVPL (PMEL_HUMAN)
  Core: VVSTQLIMP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAXVSXQXIMXGQEAGLGQVPL

SEQ ID NO: 339079 - protein, 25 aa, Artificial Sequence
  Description of Artificial Sequence: Synthetic peptide
  Seed: TNSLAVVSTQLIMPGQEAGLGQVPL (PMEL_HUMAN)
  Core: VSTQLIMPG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVXSTXLXMPXQEAGLGQVPL

SEQ ID NO: 339080 - protein, 25 aa, Artificial Sequence
  Description of Artificial Sequence: Synthetic peptide
  Seed: TNSLAVVSTQLIMPGQEAGLGQVPL (PMEL_HUMAN)
  Core: QLIMPGQEA
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTXLIXPXQEXGLGQVPL

SEQ ID NO: 339081 - protein, 25 aa, Artificial Sequence
  Description of Artificial Sequence: Synthetic peptide
  Seed: TNSLAVVSTQLIMPGQEAGLGQVPL (PMEL_HUMAN)
  Core: IMPGQEAGL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TNSLAVVSTQLXMPXQXAGXGQVPL

SEQ ID NO: 339082 - protein, 15 aa, Artificial Sequence
  Description of Artificial Sequence: Synthetic peptide
  Seed: TPAEVSIVVLSGTTA (PMEL_HUMAN)
  Core: EVSIVVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPAXVSXVXLSXTTA

SEQ ID NO: 339083 - protein, 15 aa, Artificial Sequence
  Description of Artificial Sequence: Synthetic peptide
  Seed: TPAEVSIVVLSGTTA (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTX

SEQ ID NO: 339084 - protein, 16 aa, Artificial Sequence
  Description of Artificial Sequence: Synthetic peptide
  Seed: TPAEVSIVVLSGTTAA (PMEL_HUMAN)
  Core: EVSIVVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPAXVSXVXLSXTTAA

SEQ ID NO: 339085 - protein, 16 aa, Artificial Sequence
  Description of Artificial Sequence: Synthetic peptide
  Seed: TPAEVSIVVLSGTTAA (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXA

SEQ ID NO: 339086 - protein, 17 aa, Artificial Sequence
  Description of Artificial Sequence: Synthetic peptide
  Seed: TPAEVSIVVLSGTTAAQ (PMEL_HUMAN)
  Core: EVSIVVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPAXVSXVXLSXTTAAQ

SEQ ID NO: 339087 - protein, 17 aa, Artificial Sequence
  Description of Artificial Sequence: Synthetic peptide
  Seed: TPAEVSIVVLSGTTAAQ (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQ

SEQ ID NO: 339088 - protein, 17 aa, Artificial Sequence
  Description of Artificial Sequence: Synthetic peptide
  Seed: TPAEVSIVVLSGTTAAQ (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAX

SEQ ID NO: 339089 - protein, 18 aa, Artificial Sequence
  Description of Artificial Sequence: Synthetic peptide
  Seed: TPAEVSIVVLSGTTAAQV (PMEL_HUMAN)
  Core: EVSIVVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPAXVSXVXLSXTTAAQV

SEQ ID NO: 339090 - protein, 18 aa, Artificial Sequence
  Description of Artificial Sequence: Synthetic peptide
  Seed: TPAEVSIVVLSGTTAAQV (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQV

SEQ ID NO: 339091 - protein, 18 aa, Artificial Sequence
  Description of Artificial Sequence: Synthetic peptide
  Seed: TPAEVSIVVLSGTTAAQV (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXV

SEQ ID NO: 339092 - protein, 18 aa, Artificial Sequence
  Description of Artificial Sequence: Synthetic peptide
  Seed: TPAEVSIVVLSGTTAAQV (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQX

SEQ ID NO: 339093 - protein, 19 aa, Artificial Sequence
  Description of Artificial Sequence: Synthetic peptide
  Seed: TPAEVSIVVLSGTTAAQVT (PMEL_HUMAN)
  Core: EVSIVVLSG
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPAXVSXVXLSXTTAAQVT

SEQ ID NO: 339094 - protein, 19 aa, Artificial Sequence
  Description of Artificial Sequence: Synthetic peptide
  Seed: TPAEVSIVVLSGTTAAQVT (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVT

SEQ ID NO: 339095 - protein, 19 aa, Artificial Sequence
  Description of Artificial Sequence: Synthetic peptide
  Seed: TPAEVSIVVLSGTTAAQVT (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVT

SEQ ID NO: 339096 - protein, 19 aa, Artificial Sequence
  Description of Artificial Sequence: Synthetic peptide
  Seed: TPAEVSIVVLSGTTAAQVT (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVT

SEQ ID NO: 339097 - protein, 19 aa, Artificial Sequence
  Description of Artificial Sequence: Synthetic peptide
  Seed: TPAEVSIVVLSGTTAAQVT (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXT

SEQ ID NO: 339098 - protein, 20 aa, Artificial Sequence
  Description of Artificial Sequence: Synthetic peptide
  Seed: TPAEVSIVVLSGTTAAQVTT (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTT

SEQ ID NO: 339099 - protein, 20 aa, Artificial Sequence
  Description of Artificial Sequence: Synthetic peptide
  Seed: TPAEVSIVVLSGTTAAQVTT (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTT

SEQ ID NO: 339100 - protein, 20 aa, Artificial Sequence
  Description of Artificial Sequence: Synthetic peptide
  Seed: TPAEVSIVVLSGTTAAQVTT (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTT

SEQ ID NO: 339101 - protein, 20 aa, Artificial Sequence
  Description of Artificial Sequence: Synthetic peptide
  Seed: TPAEVSIVVLSGTTAAQVTT (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTT

SEQ ID NO: 339102 - protein, 21 aa, Artificial Sequence
  Description of Artificial Sequence: Synthetic peptide
  Seed: TPAEVSIVVLSGTTAAQVTTT (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTTT

SEQ ID NO: 339103 - protein, 21 aa, Artificial Sequence
  Description of Artificial Sequence: Synthetic peptide
  Seed: TPAEVSIVVLSGTTAAQVTTT (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTTT

SEQ ID NO: 339104 - protein, 21 aa, Artificial Sequence
  Description of Artificial Sequence: Synthetic peptide
  Seed: TPAEVSIVVLSGTTAAQVTTT (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTTT

SEQ ID NO: 339105 - protein, 21 aa, Artificial Sequence
  Description of Artificial Sequence: Synthetic peptide
  Seed: TPAEVSIVVLSGTTAAQVTTT (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTTT

SEQ ID NO: 339106 - protein, 22 aa, Artificial Sequence
  Description of Artificial Sequence: Synthetic peptide
  Seed: TPAEVSIVVLSGTTAAQVTTTE (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTTTE

SEQ ID NO: 339107 - protein, 22 aa, Artificial Sequence
  Description of Artificial Sequence: Synthetic peptide
  Seed: TPAEVSIVVLSGTTAAQVTTTE (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTTTE

SEQ ID NO: 339108 - protein, 22 aa, Artificial Sequence
  Description of Artificial Sequence: Synthetic peptide
  Seed: TPAEVSIVVLSGTTAAQVTTTE (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTTTE

SEQ ID NO: 339109 - protein, 22 aa, Artificial Sequence
  Description of Artificial Sequence: Synthetic peptide
  Seed: TPAEVSIVVLSGTTAAQVTTTE (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTTTE

SEQ ID NO: 339110 - protein, 23 aa, Artificial Sequence
  Description of Artificial Sequence: Synthetic peptide
  Seed: TPAEVSIVVLSGTTAAQVTTTEW (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTTTEW

SEQ ID NO: 339111 - protein, 23 aa, Artificial Sequence
  Description of Artificial Sequence: Synthetic peptide
  Seed: TPAEVSIVVLSGTTAAQVTTTEW (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTTTEW

SEQ ID NO: 339112 - protein, 23 aa, Artificial Sequence
  Description of Artificial Sequence: Synthetic peptide
  Seed: TPAEVSIVVLSGTTAAQVTTTEW (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTTTEW

SEQ ID NO: 339113 - protein, 23 aa, Artificial Sequence
  Description of Artificial Sequence: Synthetic peptide
  Seed: TPAEVSIVVLSGTTAAQVTTTEW (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTTTEW

SEQ ID NO: 339114 - protein, 23 aa, Artificial Sequence
  Description of Artificial Sequence: Synthetic peptide
  Seed: TPAEVSIVVLSGTTAAQVTTTEW (PMEL_HUMAN)
  Core: TTAAQVTTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVLSGXTAXQXTTXEW

SEQ ID NO: 339115 - protein, 24 aa, Artificial Sequence
  Description of Artificial Sequence: Synthetic peptide
  Seed: TPAEVSIVVLSGTTAAQVTTTEWV (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTTTEWV

SEQ ID NO: 339116 - protein, 24 aa, Artificial Sequence
  Description of Artificial Sequence: Synthetic peptide
  Seed: TPAEVSIVVLSGTTAAQVTTTEWV (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTTTEWV

SEQ ID NO: 339117 - protein, 24 aa, Artificial Sequence
  Description of Artificial Sequence: Synthetic peptide
  Seed: TPAEVSIVVLSGTTAAQVTTTEWV (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTTTEWV

SEQ ID NO: 339118 - protein, 24 aa, Artificial Sequence
  Description of Artificial Sequence: Synthetic peptide
  Seed: TPAEVSIVVLSGTTAAQVTTTEWV (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTTTEWV

SEQ ID NO: 339119 - protein, 24 aa, Artificial Sequence
  Description of Artificial Sequence: Synthetic peptide
  Seed: TPAEVSIVVLSGTTAAQVTTTEWV (PMEL_HUMAN)
  Core: TTAAQVTTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVLSGXTAXQXTTXEWV

SEQ ID NO: 339120 - protein, 25 aa, Artificial Sequence
  Description of Artificial Sequence: Synthetic peptide
  Seed: TPAEVSIVVLSGTTAAQVTTTEWVE (PMEL_HUMAN)
  Core: IVVLSGTTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSXVVXSXTTXAQVTTTEWVE

SEQ ID NO: 339121 - protein, 25 aa, Artificial Sequence
  Description of Artificial Sequence: Synthetic peptide
  Seed: TPAEVSIVVLSGTTAAQVTTTEWVE (PMEL_HUMAN)
  Core: VVLSGTTAA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIXVLXGXTAXQVTTTEWVE

SEQ ID NO: 339122 - protein, 25 aa, Artificial Sequence
  Description of Artificial Sequence: Synthetic peptide
  Seed: TPAEVSIVVLSGTTAAQVTTTEWVE (PMEL_HUMAN)
  Core: VLSGTTAAQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVXLSXTXAAXVTTTEWVE

SEQ ID NO: 339123 - protein, 25 aa, Artificial Sequence
  Description of Artificial Sequence: Synthetic peptide
  Seed: TPAEVSIVVLSGTTAAQVTTTEWVE (PMEL_HUMAN)
  Core: LSGTTAAQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVXSGXTXAQXTTTEWVE

SEQ ID NO: 339124 - protein, 25 aa, Artificial Sequence
  Description of Artificial Sequence: Synthetic peptide
  Seed: TPAEVSIVVLSGTTAAQVTTTEWVE (PMEL_HUMAN)
  Core: TTAAQVTTT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TPAEVSIVVLSGXTAXQXTTXEWVE

SEQ ID NO: 339125 - protein, 14 aa, Artificial Sequence
  Description of Artificial Sequence: Synthetic peptide
  Seed: TPEATGMTPAEVSI (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSI

SEQ ID NO: 339126 - protein, 15 aa, Artificial Sequence
  Description of Artificial Sequence: Synthetic peptide
  Seed: TPEATGMTPAEVSIV (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIV

SEQ ID NO: 339127 - protein, 16 aa, Artificial Sequence
  Description of Artificial Sequence: Synthetic peptide
  Seed: TPEATGMTPAEVSIVV (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVV

SEQ ID NO: 339128 - protein, 16 aa, Artificial Sequence
  Description of Artificial Sequence: Synthetic peptide
  Seed: TPEATGMTPAEVSIVV (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXV

SEQ ID NO: 339129 - protein, 17 aa, Artificial Sequence
  Description of Artificial Sequence: Synthetic peptide
  Seed: TPEATGMTPAEVSIVVL (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVL

SEQ ID NO: 339130 - protein, 17 aa, Artificial Sequence
  Description of Artificial Sequence: Synthetic peptide
  Seed: TPEATGMTPAEVSIVVL (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVL

SEQ ID NO: 339131 - protein, 18 aa, Artificial Sequence
  Description of Artificial Sequence: Synthetic peptide
  Seed: TPEATGMTPAEVSIVVLS (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLS

SEQ ID NO: 339132 - protein, 18 aa, Artificial Sequence
  Description of Artificial Sequence: Synthetic peptide
  Seed: TPEATGMTPAEVSIVVLS (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLS

SEQ ID NO: 339133 - protein, 19 aa, Artificial Sequence
  Description of Artificial Sequence: Synthetic peptide
  Seed: TPEATGMTPAEVSIVVLSG (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSG

SEQ ID NO: 339134 - protein, 20 aa, Artificial Sequence
  Description of Artificial Sequence: Synthetic peptide
  Seed: TPEATGMTPAEVSIVVLSGT (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGT

SEQ ID NO: 339135 - protein, 20 aa, Artificial Sequence
  Description of Artificial Sequence: Synthetic peptide
  Seed: TPEATGMTPAEVSIVVLSGT (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGT

SEQ ID NO: 339136 - protein, 21 aa, Artificial Sequence
  Description of Artificial Sequence: Synthetic peptide
  Seed: TPEATGMTPAEVSIVVLSGTT (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGTT

SEQ ID NO: 339137 - protein, 21 aa, Artificial Sequence
  Description of Artificial Sequence: Synthetic peptide
  Seed: TPEATGMTPAEVSIVVLSGTT (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGTT

SEQ ID NO: 339138 - protein, 22 aa, Artificial Sequence
  Description of Artificial Sequence: Synthetic peptide
  Seed: TPEATGMTPAEVSIVVLSGTTA (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGTTA

SEQ ID NO: 339139 - protein, 22 aa, Artificial Sequence
  Description of Artificial Sequence: Synthetic peptide
  Seed: TPEATGMTPAEVSIVVLSGTTA (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGTTA

SEQ ID NO: 339140 - protein, 22 aa, Artificial Sequence
  Description of Artificial Sequence: Synthetic peptide
  Seed: TPEATGMTPAEVSIVVLSGTTA (PMEL_HUMAN)
  Core: EVSIVVLSG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAXVSXVXLSXTTA

SEQ ID NO: 339141 - protein, 23 aa, Artificial Sequence
  Description of Artificial Sequence: Synthetic peptide
  Seed: TPEATGMTPAEVSIVVLSGTTAA (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGTTAA

SEQ ID NO: 339142 - protein, 23 aa, Artificial Sequence
  Description of Artificial Sequence: Synthetic peptide
  Seed: TPEATGMTPAEVSIVVLSGTTAA (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGTTAA

SEQ ID NO: 339143 - protein, 23 aa, Artificial Sequence
  Description of Artificial Sequence: Synthetic peptide
  Seed: TPEATGMTPAEVSIVVLSGTTAA (PMEL_HUMAN)
  Core: EVSIVVLSG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAXVSXVXLSXTTAA

SEQ ID NO: 339144 - protein, 23 aa, Artificial Sequence
  Description of Artificial Sequence: Synthetic peptide
  Seed: TPEATGMTPAEVSIVVLSGTTAA (PMEL_HUMAN)
  Core: IVVLSGTTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAEVSXVVXSXTTXA

SEQ ID NO: 339145 - protein, 24 aa, Artificial Sequence
  Description of Artificial Sequence: Synthetic peptide
  Seed: TPEATGMTPAEVSIVVLSGTTAAQ (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGTTAAQ

SEQ ID NO: 339146 - protein, 24 aa, Artificial Sequence
  Description of Artificial Sequence: Synthetic peptide
  Seed: TPEATGMTPAEVSIVVLSGTTAAQ (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGTTAAQ

SEQ ID NO: 339147 - protein, 24 aa, Artificial Sequence
  Description of Artificial Sequence: Synthetic peptide
  Seed: TPEATGMTPAEVSIVVLSGTTAAQ (PMEL_HUMAN)
  Core: EVSIVVLSG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAXVSXVXLSXTTAAQ

SEQ ID NO: 339148 - protein, 24 aa, Artificial Sequence
  Description of Artificial Sequence: Synthetic peptide
  Seed: TPEATGMTPAEVSIVVLSGTTAAQ (PMEL_HUMAN)
  Core: IVVLSGTTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAEVSXVVXSXTTXAQ

SEQ ID NO: 339149 - protein, 25 aa, Artificial Sequence
  Description of Artificial Sequence: Synthetic peptide
  Seed: TPEATGMTPAEVSIVVLSGTTAAQV (PMEL_HUMAN)
  Core: ATGMTPAEV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TPEXTGXTXAEXSIVVLSGTTAAQV

SEQ ID NO: 339150 - protein, 25 aa, Artificial Sequence
  Description of Artificial Sequence: Synthetic peptide
  Seed: TPEATGMTPAEVSIVVLSGTTAAQV (PMEL_HUMAN)
  Core: MTPAEVSIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGXTPXEXSIXVLSGTTAAQV

SEQ ID NO: 339151 - protein, 25 aa, Artificial Sequence
  Description of Artificial Sequence: Synthetic peptide
  Seed: TPEATGMTPAEVSIVVLSGTTAAQV (PMEL_HUMAN)
  Core: EVSIVVLSG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAXVSXVXLSXTTAAQV

SEQ ID NO: 339152 - protein, 25 aa, Artificial Sequence
  Description of Artificial Sequence: Synthetic peptide
  Seed: TPEATGMTPAEVSIVVLSGTTAAQV (PMEL_HUMAN)
  Core: IVVLSGTTA
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAEVSXVVXSXTTXAQV

SEQ ID NO: 339153 - protein, 25 aa, Artificial Sequence
  Description of Artificial Sequence: Synthetic peptide
  Seed: TPEATGMTPAEVSIVVLSGTTAAQV (PMEL_HUMAN)
  Core: LSGTTAAQV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
TPEATGMTPAEVSIVVXSGXTXAQX

SEQ ID NO: 339154 - protein, 15 aa, Artificial Sequence
  Description of Artificial Sequence: Synthetic peptide
  Seed: TPEKVPVSEVMGTTL (PMEL_HUMAN)
  Core: VPVSEVMGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPEKXPVXEXMGXTL

SEQ ID NO: 339155 - protein, 16 aa, Artificial Sequence
  Description of Artificial Sequence: Synthetic peptide
  Seed: TPEKVPVSEVMGTTLA (PMEL_HUMAN)
  Core: VPVSEVMGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPEKXPVXEXMGXTLA

SEQ ID NO: 339156 - protein, 17 aa, Artificial Sequence
  Description of Artificial Sequence: Synthetic peptide
  Seed: TPEKVPVSEVMGTTLAE (PMEL_HUMAN)
  Core: VPVSEVMGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TPEKXPVXEXMGXTLAE

SEQ ID NO: 339157 - protein, 18 aa, Artificial Sequence
  Description of Artificial Sequence: Synthetic peptide
  Seed: TPEKVPVSEVMGTTLAEM (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEX

SEQ ID NO: 339158 - protein, 19 aa, Artificial Sequence
  Description of Artificial Sequence: Synthetic peptide
  Seed: TPEKVPVSEVMGTTLAEMS (PMEL_HUMAN)
  Core: VSEVMGTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPXSEXMXTTXAEMS

SEQ ID NO: 339159 - protein, 19 aa, Artificial Sequence
  Description of Artificial Sequence: Synthetic peptide
  Seed: TPEKVPVSEVMGTTLAEMS (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXS

SEQ ID NO: 339160 - protein, 19 aa, Artificial Sequence
  Description of Artificial Sequence: Synthetic peptide
  Seed: TPEKVPVSEVMGTTLAEMS (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMX

SEQ ID NO: 339161 - protein, 20 aa, Artificial Sequence
  Description of Artificial Sequence: Synthetic peptide
  Seed: TPEKVPVSEVMGTTLAEMST (PMEL_HUMAN)
  Core: VSEVMGTTL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPXSEXMXTTXAEMST

SEQ ID NO: 339162 - protein, 20 aa, Artificial Sequence
  Description of Artificial Sequence: Synthetic peptide
  Seed: TPEKVPVSEVMGTTLAEMST (PMEL_HUMAN)
  Core: SEVMGTTLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVXEVXGXTLXEMST

SEQ ID NO: 339163 - protein, 20 aa, Artificial Sequence
  Description of Artificial Sequence: Synthetic peptide
  Seed: TPEKVPVSEVMGTTLAEMST (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXST

SEQ ID NO: 339164 - protein, 20 aa, Artificial Sequence
  Description of Artificial Sequence: Synthetic peptide
  Seed: TPEKVPVSEVMGTTLAEMST (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXT

SEQ ID NO: 339165 - protein, 21 aa, Artificial Sequence
  Description of Artificial Sequence: Synthetic peptide
  Seed: TPEKVPVSEVMGTTLAEMSTP (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXSTP

SEQ ID NO: 339166 - protein, 21 aa, Artificial Sequence
  Description of Artificial Sequence: Synthetic peptide
  Seed: TPEKVPVSEVMGTTLAEMSTP (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXTP

SEQ ID NO: 339167 - protein, 22 aa, Artificial Sequence
  Description of Artificial Sequence: Synthetic peptide
  Seed: TPEKVPVSEVMGTTLAEMSTPE (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXSTPE

SEQ ID NO: 339168 - protein, 22 aa, Artificial Sequence
  Description of Artificial Sequence: Synthetic peptide
  Seed: TPEKVPVSEVMGTTLAEMSTPE (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXTPE

SEQ ID NO: 339169 - protein, 23 aa, Artificial Sequence
  Description of Artificial Sequence: Synthetic peptide
  Seed: TPEKVPVSEVMGTTLAEMSTPEA (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXSTPEA

SEQ ID NO: 339170 - protein, 23 aa, Artificial Sequence
  Description of Artificial Sequence: Synthetic peptide
  Seed: TPEKVPVSEVMGTTLAEMSTPEA (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXTPEA

SEQ ID NO: 339171 - protein, 24 aa, Artificial Sequence
  Description of Artificial Sequence: Synthetic peptide
  Seed: TPEKVPVSEVMGTTLAEMSTPEAT (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXSTPEAT

SEQ ID NO: 339172 - protein, 24 aa, Artificial Sequence
  Description of Artificial Sequence: Synthetic peptide
  Seed: TPEKVPVSEVMGTTLAEMSTPEAT (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXTPEAT

SEQ ID NO: 339173 - protein, 24 aa, Artificial Sequence
  Description of Artificial Sequence: Synthetic peptide
  Seed: TPEKVPVSEVMGTTLAEMSTPEAT (PMEL_HUMAN)
  Core: LAEMSTPEA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVMGTTXAEXSXPEXT

SEQ ID NO: 339174 - protein, 25 aa, Artificial Sequence
  Description of Artificial Sequence: Synthetic peptide
  Seed: TPEKVPVSEVMGTTLAEMSTPEATG (PMEL_HUMAN)
  Core: VMGTTLAEM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEXMGXTXAEXSTPEATG

SEQ ID NO: 339175 - protein, 25 aa, Artificial Sequence
  Description of Artificial Sequence: Synthetic peptide
  Seed: TPEKVPVSEVMGTTLAEMSTPEATG (PMEL_HUMAN)
  Core: MGTTLAEMS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVXGTXLXEMXTPEATG

SEQ ID NO: 339176 - protein, 25 aa, Artificial Sequence
  Description of Artificial Sequence: Synthetic peptide
  Seed: TPEKVPVSEVMGTTLAEMSTPEATG (PMEL_HUMAN)
  Core: LAEMSTPEA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TPEKVPVSEVMGTTXAEXSXPEXTG

SEQ ID NO: 339177 - protein, 19 aa, Artificial Sequence
  Description of Artificial Sequence: Synthetic peptide
  Seed: TPGQAPTAEPSGTTSVQVP (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXP

SEQ ID NO: 339178 - protein, 20 aa, Artificial Sequence
  Description of Artificial Sequence: Synthetic peptide
  Seed: TPGQAPTAEPSGTTSVQVPT (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPT

SEQ ID NO: 339179 - protein, 21 aa, Artificial Sequence
  Description of Artificial Sequence: Synthetic peptide
  Seed: TPGQAPTAEPSGTTSVQVPTT (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPTT

SEQ ID NO: 339180 - protein, 22 aa, Artificial Sequence
  Description of Artificial Sequence: Synthetic peptide
  Seed: TPGQAPTAEPSGTTSVQVPTTE (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPTTE

SEQ ID NO: 339181 - protein, 23 aa, Artificial Sequence
  Description of Artificial Sequence: Synthetic peptide
  Seed: TPGQAPTAEPSGTTSVQVPTTEV (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPTTEV

SEQ ID NO: 339182 - protein, 24 aa, Artificial Sequence
  Description of Artificial Sequence: Synthetic peptide
  Seed: TPGQAPTAEPSGTTSVQVPTTEVI (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPTTEVI

SEQ ID NO: 339183 - protein, 25 aa, Artificial Sequence
  Description of Artificial Sequence: Synthetic peptide
  Seed: TPGQAPTAEPSGTTSVQVPTTEVIS (PMEL_HUMAN)
  Core: PSGTTSVQV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TPGQAPTAEXSGXTXVQXPTTEVIS

SEQ ID NO: 339184 - protein, 15 aa, Artificial Sequence
  Description of Artificial Sequence: Synthetic peptide
  Seed: TQLIMPGQEAGLGQV (PMEL_HUMAN)
  Core: IMPGQEAGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TQLXMPXQXAGXGQV

SEQ ID NO: 339185 - protein, 16 aa, Artificial Sequence
  Description of Artificial Sequence: Synthetic peptide
  Seed: TQLIMPGQEAGLGQVP (PMEL_HUMAN)
  Core: IMPGQEAGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TQLXMPXQXAGXGQVP

SEQ ID NO: 339186 - protein, 19 aa, Artificial Sequence
  Description of Artificial Sequence: Synthetic peptide
  Seed: TQLIMPGQEAGLGQVPLIV (PMEL_HUMAN)
  Core: IMPGQEAGL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TQLXMPXQXAGXGQVPLIV

SEQ ID NO: 339187 - protein, 20 aa, Artificial Sequence
  Description of Artificial Sequence: Synthetic peptide
  Seed: TQLIMPGQEAGLGQVPLIVG (PMEL_HUMAN)
  Core: EAGLGQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQXAGXGXVPXIVG

SEQ ID NO: 339188 - protein, 20 aa, Artificial Sequence
  Description of Artificial Sequence: Synthetic peptide
  Seed: TQLIMPGQEAGLGQVPLIVG (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVG

SEQ ID NO: 339189 - protein, 20 aa, Artificial Sequence
  Description of Artificial Sequence: Synthetic peptide
  Seed: TQLIMPGQEAGLGQVPLIVG (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVX

SEQ ID NO: 339190 - protein, 21 aa, Artificial Sequence
  Description of Artificial Sequence: Synthetic peptide
  Seed: TQLIMPGQEAGLGQVPLIVGI (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVGI

SEQ ID NO: 339191 - protein, 21 aa, Artificial Sequence
  Description of Artificial Sequence: Synthetic peptide
  Seed: TQLIMPGQEAGLGQVPLIVGI (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVXI

SEQ ID NO: 339192 - protein, 22 aa, Artificial Sequence
  Description of Artificial Sequence: Synthetic peptide
  Seed: TQLIMPGQEAGLGQVPLIVGIL (PMEL_HUMAN)
  Core: EAGLGQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQXAGXGXVPXIVGIL

SEQ ID NO: 339193 - protein, 22 aa, Artificial Sequence
  Description of Artificial Sequence: Synthetic peptide
  Seed: TQLIMPGQEAGLGQVPLIVGIL (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVGIL

SEQ ID NO: 339194 - protein, 22 aa, Artificial Sequence
  Description of Artificial Sequence: Synthetic peptide
  Seed: TQLIMPGQEAGLGQVPLIVGIL (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVXIL

SEQ ID NO: 339195 - protein, 23 aa, Artificial Sequence
  Description of Artificial Sequence: Synthetic peptide
  Seed: TQLIMPGQEAGLGQVPLIVGILL (PMEL_HUMAN)
  Core: EAGLGQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQXAGXGXVPXIVGILL

SEQ ID NO: 339196 - protein, 23 aa, Artificial Sequence
  Description of Artificial Sequence: Synthetic peptide
  Seed: TQLIMPGQEAGLGQVPLIVGILL (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVGILL

SEQ ID NO: 339197 - protein, 23 aa, Artificial Sequence
  Description of Artificial Sequence: Synthetic peptide
  Seed: TQLIMPGQEAGLGQVPLIVGILL (PMEL_HUMAN)
  Core: GLGQVPLIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAXLGXVXLIXGILL

SEQ ID NO: 339198 - protein, 23 aa, Artificial Sequence
  Description of Artificial Sequence: Synthetic peptide
  Seed: TQLIMPGQEAGLGQVPLIVGILL (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVXILL

SEQ ID NO: 339199 - protein, 24 aa, Artificial Sequence
  Description of Artificial Sequence: Synthetic peptide
  Seed: TQLIMPGQEAGLGQVPLIVGILLV (PMEL_HUMAN)
  Core: EAGLGQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQXAGXGXVPXIVGILLV

SEQ ID NO: 339200 - protein, 24 aa, Artificial Sequence
  Description of Artificial Sequence: Synthetic peptide
  Seed: TQLIMPGQEAGLGQVPLIVGILLV (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVGILLV

SEQ ID NO: 339201 - protein, 24 aa, Artificial Sequence
  Description of Artificial Sequence: Synthetic peptide
  Seed: TQLIMPGQEAGLGQVPLIVGILLV (PMEL_HUMAN)
  Core: GLGQVPLIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAXLGXVXLIXGILLV

SEQ ID NO: 339202 - protein, 24 aa, Artificial Sequence
  Description of Artificial Sequence: Synthetic peptide
  Seed: TQLIMPGQEAGLGQVPLIVGILLV (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVXILLV

SEQ ID NO: 339203 - protein, 25 aa, Artificial Sequence
  Description of Artificial Sequence: Synthetic peptide
  Seed: TQLIMPGQEAGLGQVPLIVGILLVL (PMEL_HUMAN)
  Core: EAGLGQVPL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQXAGXGXVPXIVGILLVL

SEQ ID NO: 339204 - protein, 25 aa, Artificial Sequence
  Description of Artificial Sequence: Synthetic peptide
  Seed: TQLIMPGQEAGLGQVPLIVGILLVL (PMEL_HUMAN)
  Core: AGLGQVPLI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEXGLXQXPLXVGILLVL

SEQ ID NO: 339205 - protein, 25 aa, Artificial Sequence
  Description of Artificial Sequence: Synthetic peptide
  Seed: TQLIMPGQEAGLGQVPLIVGILLVL (PMEL_HUMAN)
  Core: GLGQVPLIV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAXLGXVXLIXGILLVL

SEQ ID NO: 339206 - protein, 25 aa, Artificial Sequence
  Description of Artificial Sequence: Synthetic peptide
  Seed: TQLIMPGQEAGLGQVPLIVGILLVL (PMEL_HUMAN)
  Core: LGQVPLIVG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TQLIMPGQEAGXGQXPXIVXILLVL

SEQ ID NO: 339207 - protein, 15 aa, Artificial Sequence
  Description of Artificial Sequence: Synthetic peptide
  Seed: TSCGSSPVPGTTDGH (PMEL_HUMAN)
  Core: CGSSPVPGT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TSXGSXPXPGXTDGH

SEQ ID NO: 339208 - protein, 15 aa, Artificial Sequence
  Description of Artificial Sequence: Synthetic peptide
  Seed: TSVQVPTTEVISTAP (PMEL_HUMAN)
  Core: PTTEVISTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVXTTXVXSTXP

SEQ ID NO: 339209 - protein, 16 aa, Artificial Sequence
  Description of Artificial Sequence: Synthetic peptide
  Seed: TSVQVPTTEVISTAPV (PMEL_HUMAN)
  Core: PTTEVISTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVXTTXVXSTXPV

SEQ ID NO: 339210 - protein, 17 aa, Artificial Sequence
  Description of Artificial Sequence: Synthetic peptide
  Seed: TSVQVPTTEVISTAPVQ (PMEL_HUMAN)
  Core: PTTEVISTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVXTTXVXSTXPVQ

SEQ ID NO: 339211 - protein, 19 aa, Artificial Sequence
  Description of Artificial Sequence: Synthetic peptide
  Seed: TSVQVPTTEVISTAPVQMP (PMEL_HUMAN)
  Core: PTTEVISTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVXTTXVXSTXPVQMP

SEQ ID NO: 339212 - protein, 19 aa, Artificial Sequence
  Description of Artificial Sequence: Synthetic peptide
  Seed: TSVQVPTTEVISTAPVQMP (PMEL_HUMAN)
  Core: TEVISTAPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTXEVXSXAPXQMP

SEQ ID NO: 339213 - protein, 19 aa, Artificial Sequence
  Description of Artificial Sequence: Synthetic peptide
  Seed: TSVQVPTTEVISTAPVQMP (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXP

SEQ ID NO: 339214 - protein, 20 aa, Artificial Sequence
  Description of Artificial Sequence: Synthetic peptide
  Seed: TSVQVPTTEVISTAPVQMPT (PMEL_HUMAN)
  Core: TEVISTAPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTXEVXSXAPXQMPT

SEQ ID NO: 339215 - protein, 20 aa, Artificial Sequence
  Description of Artificial Sequence: Synthetic peptide
  Seed: TSVQVPTTEVISTAPVQMPT (PMEL_HUMAN)
  Core: EVISTAPVQ
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTXVIXTXPVXMPT

SEQ ID NO: 339216 - protein, 20 aa, Artificial Sequence
  Description of Artificial Sequence: Synthetic peptide
  Seed: TSVQVPTTEVISTAPVQMPT (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPT

SEQ ID NO: 339217 - protein, 21 aa, Artificial Sequence
  Description of Artificial Sequence: Synthetic peptide
  Seed: TSVQVPTTEVISTAPVQMPTA (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPTA

SEQ ID NO: 339218 - protein, 21 aa, Artificial Sequence
  Description of Artificial Sequence: Synthetic peptide
  Seed: TSVQVPTTEVISTAPVQMPTA (PMEL_HUMAN)
  Core: ISTAPVQMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEVXSTXPXQMXTA

SEQ ID NO: 339219 - protein, 22 aa, Artificial Sequence
  Description of Artificial Sequence: Synthetic peptide
  Seed: TSVQVPTTEVISTAPVQMPTAE (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPTAE

SEQ ID NO: 339220 - protein, 22 aa, Artificial Sequence
  Description of Artificial Sequence: Synthetic peptide
  Seed: TSVQVPTTEVISTAPVQMPTAE (PMEL_HUMAN)
  Core: ISTAPVQMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEVXSTXPXQMXTAE

SEQ ID NO: 339221 - protein, 23 aa, Artificial Sequence
  Description of Artificial Sequence: Synthetic peptide
  Seed: TSVQVPTTEVISTAPVQMPTAES (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPTAES

SEQ ID NO: 339222 - protein, 23 aa, Artificial Sequence
  Description of Artificial Sequence: Synthetic peptide
  Seed: TSVQVPTTEVISTAPVQMPTAES (PMEL_HUMAN)
  Core: ISTAPVQMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEVXSTXPXQMXTAES

SEQ ID NO: 339223 - protein, 24 aa, Artificial Sequence
  Description of Artificial Sequence: Synthetic peptide
  Seed: TSVQVPTTEVISTAPVQMPTAEST (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPTAEST

SEQ ID NO: 339224 - protein, 24 aa, Artificial Sequence
  Description of Artificial Sequence: Synthetic peptide
  Seed: TSVQVPTTEVISTAPVQMPTAEST (PMEL_HUMAN)
  Core: ISTAPVQMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEVXSTXPXQMXTAEST

SEQ ID NO: 339225 - protein, 25 aa, Artificial Sequence
  Description of Artificial Sequence: Synthetic peptide
  Seed: TSVQVPTTEVISTAPVQMPTAESTG (PMEL_HUMAN)
  Core: VISTAPVQM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEXISXAXVQXPTAESTG

SEQ ID NO: 339226 - protein, 25 aa, Artificial Sequence
  Description of Artificial Sequence: Synthetic peptide
  Seed: TSVQVPTTEVISTAPVQMPTAESTG (PMEL_HUMAN)
  Core: ISTAPVQMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TSVQVPTTEVXSTXPXQMXTAESTG

SEQ ID NO: 339227 - protein, 13 aa, Artificial Sequence
  Description of Artificial Sequence: Synthetic peptide
  Seed: TTAAQVTTTEWVE (PMEL_HUMAN)
  Core: AQVTTTEWV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTAXQVXTXEWXE

SEQ ID NO: 339228 - protein, 14 aa, Artificial Sequence
  Description of Artificial Sequence: Synthetic peptide
  Seed: TTAAQVTTTEWVET (PMEL_HUMAN)
  Core: QVTTTEWVE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTAAXVTXTXWVXT

SEQ ID NO: 339229 - protein, 15 aa, Artificial Sequence
  Description of Artificial Sequence: Synthetic peptide
  Seed: TTAAQVTTTEWVETT (PMEL_HUMAN)
  Core: AQVTTTEWV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTAXQVXTXEWXETT

SEQ ID NO: 339230 - protein, 15 aa, Artificial Sequence
  Description of Artificial Sequence: Synthetic peptide
  Seed: TTAAQVTTTEWVETT (PMEL_HUMAN)
  Core: QVTTTEWVE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTAAXVTXTXWVXTT

SEQ ID NO: 339231 - protein, 15 aa, Artificial Sequence
  Description of Artificial Sequence: Synthetic peptide
  Seed: TTAAQVTTTEWVETT (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXT

SEQ ID NO: 339232 - protein, 15 aa, Artificial Sequence
  Description of Artificial Sequence: Synthetic peptide
  Seed: TTAAQVTTTEWVETT (PMEL_HUMAN)
  Core: TTTEWVETT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVXTTXWXETX

SEQ ID NO: 339233 - protein, 16 aa, Artificial Sequence
  Description of Artificial Sequence: Synthetic peptide
  Seed: TTAAQVTTTEWVETTA (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTA

SEQ ID NO: 339234 - protein, 16 aa, Artificial Sequence
  Description of Artificial Sequence: Synthetic peptide
  Seed: TTAAQVTTTEWVETTA (PMEL_HUMAN)
  Core: TTTEWVETT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVXTTXWXETXA

SEQ ID NO: 339235 - protein, 17 aa, Artificial Sequence
  Description of Artificial Sequence: Synthetic peptide
  Seed: TTAAQVTTTEWVETTAR (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTAR

SEQ ID NO: 339236 - protein, 17 aa, Artificial Sequence
  Description of Artificial Sequence: Synthetic peptide
  Seed: TTAAQVTTTEWVETTAR (PMEL_HUMAN)
  Core: TTTEWVETT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVXTTXWXETXAR

SEQ ID NO: 339237 - protein, 19 aa, Artificial Sequence
  Description of Artificial Sequence: Synthetic peptide
  Seed: TTAAQVTTTEWVETTAREL (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTAREL

SEQ ID NO: 339238 - protein, 19 aa, Artificial Sequence
  Description of Artificial Sequence: Synthetic peptide
  Seed: TTAAQVTTTEWVETTAREL (PMEL_HUMAN)
  Core: TTTEWVETT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVXTTXWXETXAREL

SEQ ID NO: 339239 - protein, 19 aa, Artificial Sequence
  Description of Artificial Sequence: Synthetic peptide
  Seed: TTAAQVTTTEWVETTAREL (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREX

SEQ ID NO: 339240 - protein, 20 aa, Artificial Sequence
  Description of Artificial Sequence: Synthetic peptide
  Seed: TTAAQVTTTEWVETTARELP (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELP

SEQ ID NO: 339241 - protein, 20 aa, Artificial Sequence
  Description of Artificial Sequence: Synthetic peptide
  Seed: TTAAQVTTTEWVETTARELP (PMEL_HUMAN)
  Core: TTTEWVETT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVXTTXWXETXARELP

SEQ ID NO: 339242 - protein, 20 aa, Artificial Sequence
  Description of Artificial Sequence: Synthetic peptide
  Seed: TTAAQVTTTEWVETTARELP (PMEL_HUMAN)
  Core: TTEWVETTA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTXTEXVXTTXRELP

SEQ ID NO: 339243 - protein, 20 aa, Artificial Sequence
  Description of Artificial Sequence: Synthetic peptide
  Seed: TTAAQVTTTEWVETTARELP (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXP

SEQ ID NO: 339244 - protein, 21 aa, Artificial Sequence
  Description of Artificial Sequence: Synthetic peptide
  Seed: TTAAQVTTTEWVETTARELPI (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELPI

SEQ ID NO: 339245 - protein, 21 aa, Artificial Sequence
  Description of Artificial Sequence: Synthetic peptide
  Seed: TTAAQVTTTEWVETTARELPI (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXPI

SEQ ID NO: 339246 - protein, 22 aa, Artificial Sequence
  Description of Artificial Sequence: Synthetic peptide
  Seed: TTAAQVTTTEWVETTARELPIP (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELPIP

SEQ ID NO: 339247 - protein, 22 aa, Artificial Sequence
  Description of Artificial Sequence: Synthetic peptide
  Seed: TTAAQVTTTEWVETTARELPIP (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXPIP

SEQ ID NO: 339248 - protein, 23 aa, Artificial Sequence
  Description of Artificial Sequence: Synthetic peptide
  Seed: TTAAQVTTTEWVETTARELPIPE (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELPIPE

SEQ ID NO: 339249 - protein, 23 aa, Artificial Sequence
  Description of Artificial Sequence: Synthetic peptide
  Seed: TTAAQVTTTEWVETTARELPIPE (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXPIPE

SEQ ID NO: 339250 - protein, 24 aa, Artificial Sequence
  Description of Artificial Sequence: Synthetic peptide
  Seed: TTAAQVTTTEWVETTARELPIPEP (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELPIPEP

SEQ ID NO: 339251 - protein, 24 aa, Artificial Sequence
  Description of Artificial Sequence: Synthetic peptide
  Seed: TTAAQVTTTEWVETTARELPIPEP (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXPIPEP

SEQ ID NO: 339252 - protein, 25 aa, Artificial Sequence
  Description of Artificial Sequence: Synthetic peptide
  Seed: TTAAQVTTTEWVETTARELPIPEPE (PMEL_HUMAN)
  Core: VTTTEWVET
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQXTTXEXVEXTARELPIPEPE

SEQ ID NO: 339253 - protein, 25 aa, Artificial Sequence
  Description of Artificial Sequence: Synthetic peptide
  Seed: TTAAQVTTTEWVETTARELPIPEPE (PMEL_HUMAN)
  Core: WVETTAREL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAAQVTTTEXVEXTXREXPIPEPE

SEQ ID NO: 339254 - protein, 13 aa, Artificial Sequence
  Description of Artificial Sequence: Synthetic peptide
  Seed: TTAGQVPTTEVVG (PMEL_HUMAN)
  Core: TTAGQVPTT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XTAXQXPTXEVVG

SEQ ID NO: 339255 - protein, 14 aa, Artificial Sequence
  Description of Artificial Sequence: Synthetic peptide
  Seed: TTAGQVPTTEVVGT (PMEL_HUMAN)
  Core: TTAGQVPTT
  misc_feature (1)..(1): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
XTAXQXPTXEVVGT

SEQ ID NO: 339256 - protein, 14 aa, Artificial Sequence
  Description of Artificial Sequence: Synthetic peptide
  Seed: TTAGQVPTTEVVGT (PMEL_HUMAN)
  Core: VPTTEVVGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQXPTXEXVGX

SEQ ID NO: 339257 - protein, 15 aa, Artificial Sequence
  Description of Artificial Sequence: Synthetic peptide
  Seed: TTAGQVPTTEVVGTT (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTX

SEQ ID NO: 339258 - protein, 16 aa, Artificial Sequence
  Description of Artificial Sequence: Synthetic peptide
  Seed: TTAGQVPTTEVVGTTP (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTXP

SEQ ID NO: 339259 - protein, 17 aa, Artificial Sequence
  Description of Artificial Sequence: Synthetic peptide
  Seed: TTAGQVPTTEVVGTTPG (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTXPG

SEQ ID NO: 339260 - protein, 19 aa, Artificial Sequence
  Description of Artificial Sequence: Synthetic peptide
  Seed: TTAGQVPTTEVVGTTPGQA (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTXPGQA

SEQ ID NO: 339261 - protein, 20 aa, Artificial Sequence
  Description of Artificial Sequence: Synthetic peptide
  Seed: TTAGQVPTTEVVGTTPGQAP (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTXPGQAP

SEQ ID NO: 339262 - protein, 20 aa, Artificial Sequence
  Description of Artificial Sequence: Synthetic peptide
  Seed: TTAGQVPTTEVVGTTPGQAP (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXP

SEQ ID NO: 339263 - protein, 21 aa, Artificial Sequence
  Description of Artificial Sequence: Synthetic peptide
  Seed: TTAGQVPTTEVVGTTPGQAPT (PMEL_HUMAN)
  Core: PTTEVVGTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVXTTXVXGTXPGQAPT

SEQ ID NO: 339264 - protein, 21 aa, Artificial Sequence
  Description of Artificial Sequence: Synthetic peptide
  Seed: TTAGQVPTTEVVGTTPGQAPT (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXPT

SEQ ID NO: 339265 - protein, 22 aa, Artificial Sequence
  Description of Artificial Sequence: Synthetic peptide
  Seed: TTAGQVPTTEVVGTTPGQAPTA (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXPTA

SEQ ID NO: 339266 - protein, 23 aa, Artificial Sequence
  Description of Artificial Sequence: Synthetic peptide
  Seed: TTAGQVPTTEVVGTTPGQAPTAE (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXPTAE

SEQ ID NO: 339267 - protein, 24 aa, Artificial Sequence
  Description of Artificial Sequence: Synthetic peptide
  Seed: TTAGQVPTTEVVGTTPGQAPTAEP (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXPTAEP

SEQ ID NO: 339268 - protein, 25 aa, Artificial Sequence
  Description of Artificial Sequence: Synthetic peptide
  Seed: TTAGQVPTTEVVGTTPGQAPTAEPS (PMEL_HUMAN)
  Core: VVGTTPGQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTAGQVPTTEXVGXTXGQXPTAEPS

SEQ ID NO: 339269 - protein, 23 aa, Artificial Sequence
  Description of Artificial Sequence: Synthetic peptide
  Seed: TTARELPIPEPEGPDASSIMSTE (PMEL_HUMAN)
  Core: PDASSIMST
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTARELPIPEPEGXDAXSXMSXE

SEQ ID NO: 339270 - protein, 24 aa, Artificial Sequence
  Description of Artificial Sequence: Synthetic peptide
  Seed: TTARELPIPEPEGPDASSIMSTES (PMEL_HUMAN)
  Core: PDASSIMST
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTARELPIPEPEGXDAXSXMSXES

SEQ ID NO: 339271 - protein, 25 aa, Artificial Sequence
  Description of Artificial Sequence: Synthetic peptide
  Seed: TTARELPIPEPEGPDASSIMSTESI (PMEL_HUMAN)
  Core: PDASSIMST
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTARELPIPEPEGXDAXSXMSXESI

SEQ ID NO: 339272 - protein, 22 aa, Artificial Sequence
  Description of Artificial Sequence: Synthetic peptide
  Seed: TTDGHRPTAEAPNTTAGQVPTT (PMEL_HUMAN)
  Core: PTAEAPNTT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTDGHRXTAXAXNTXAGQVPTT

SEQ ID NO: 339273 - protein, 23 aa, Artificial Sequence
  Description of Artificial Sequence: Synthetic peptide
  Seed: TTDGHRPTAEAPNTTAGQVPTTE (PMEL_HUMAN)
  Core: TTAGQVPTT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTDGHRPTAEAPNXTAXQXPTXE

SEQ ID NO: 339274 - protein, 24 aa, Artificial Sequence
  Description of Artificial Sequence: Synthetic peptide
  Seed: TTDGHRPTAEAPNTTAGQVPTTEV (PMEL_HUMAN)
  Core: TTAGQVPTT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTDGHRPTAEAPNXTAXQXPTXEV

SEQ ID NO: 339275 - protein, 25 aa, Artificial Sequence
  Description of Artificial Sequence: Synthetic peptide
  Seed: TTDGHRPTAEAPNTTAGQVPTTEVV (PMEL_HUMAN)
  Core: TTAGQVPTT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTDGHRPTAEAPNXTAXQXPTXEVV

SEQ ID NO: 339276 - protein, 13 aa, Artificial Sequence
  Description of Artificial Sequence: Synthetic peptide
  Seed: TTEVISTAPVQMP (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXP

SEQ ID NO: 339277 - protein, 14 aa, Artificial Sequence
  Description of Artificial Sequence: Synthetic peptide
  Seed: TTEVISTAPVQMPT (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPT

SEQ ID NO: 339278 - protein, 15 aa, Artificial Sequence
  Description of Artificial Sequence: Synthetic peptide
  Seed: TTEVISTAPVQMPTA (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTA

SEQ ID NO: 339279 - protein, 15 aa, Artificial Sequence
  Description of Artificial Sequence: Synthetic peptide
  Seed: TTEVISTAPVQMPTA (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTA

SEQ ID NO: 339280 - protein, 16 aa, Artificial Sequence
  Description of Artificial Sequence: Synthetic peptide
  Seed: TTEVISTAPVQMPTAE (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAE

SEQ ID NO: 339281 - protein, 16 aa, Artificial Sequence
  Description of Artificial Sequence: Synthetic peptide
  Seed: TTEVISTAPVQMPTAE (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAE

SEQ ID NO: 339282 - protein, 17 aa, Artificial Sequence
  Description of Artificial Sequence: Synthetic peptide
  Seed: TTEVISTAPVQMPTAES (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAES

SEQ ID NO: 339283 - protein, 17 aa, Artificial Sequence
  Description of Artificial Sequence: Synthetic peptide
  Seed: TTEVISTAPVQMPTAES (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAES

SEQ ID NO: 339284 - protein, 17 aa, Artificial Sequence
  Description of Artificial Sequence: Synthetic peptide
  Seed: TTEVISTAPVQMPTAES (PMEL_HUMAN)
  Core: TAPVQMPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISXAPXQXPTXES

SEQ ID NO: 339285 - protein, 18 aa, Artificial Sequence
  Description of Artificial Sequence: Synthetic peptide
  Seed: TTEVISTAPVQMPTAEST (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAEST

SEQ ID NO: 339286 - protein, 18 aa, Artificial Sequence
  Description of Artificial Sequence: Synthetic peptide
  Seed: TTEVISTAPVQMPTAEST (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAEST

SEQ ID NO: 339287 - protein, 19 aa, Artificial Sequence
  Description of Artificial Sequence: Synthetic peptide
  Seed: TTEVISTAPVQMPTAESTG (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTG

SEQ ID NO: 339288 - protein, 19 aa, Artificial Sequence
  Description of Artificial Sequence: Synthetic peptide
  Seed: TTEVISTAPVQMPTAESTG (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTG

SEQ ID NO: 339289 - protein, 19 aa, Artificial Sequence
  Description of Artificial Sequence: Synthetic peptide
  Seed: TTEVISTAPVQMPTAESTG (PMEL_HUMAN)
  Core: TAPVQMPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISXAPXQXPTXESTG

SEQ ID NO: 339290 - protein, 20 aa, Artificial Sequence
  Description of Artificial Sequence: Synthetic peptide
  Seed: TTEVISTAPVQMPTAESTGM (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGM

SEQ ID NO: 339291 - protein, 20 aa, Artificial Sequence
  Description of Artificial Sequence: Synthetic peptide
  Seed: TTEVISTAPVQMPTAESTGM (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGM

SEQ ID NO: 339292 - protein, 20 aa, Artificial Sequence
  Description of Artificial Sequence: Synthetic peptide
  Seed: TTEVISTAPVQMPTAESTGM (PMEL_HUMAN)
  Core: TAPVQMPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISXAPXQXPTXESTGM

SEQ ID NO: 339293 - protein, 20 aa, Artificial Sequence
  Description of Artificial Sequence: Synthetic peptide
  Seed: TTEVISTAPVQMPTAESTGM (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGM

SEQ ID NO: 339294 - protein, 20 aa, Artificial Sequence
  Description of Artificial Sequence: Synthetic peptide
  Seed: TTEVISTAPVQMPTAESTGM (PMEL_HUMAN)
  Core: VQMPTAEST
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAPXQMXTXESXGM

SEQ ID NO: 339295 - protein, 21 aa, Artificial Sequence
  Description of Artificial Sequence: Synthetic peptide
  Seed: TTEVISTAPVQMPTAESTGMT (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGMT

SEQ ID NO: 339296 - protein, 21 aa, Artificial Sequence
  Description of Artificial Sequence: Synthetic peptide
  Seed: TTEVISTAPVQMPTAESTGMT (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGMT

SEQ ID NO: 339297 - protein, 21 aa, Artificial Sequence
  Description of Artificial Sequence: Synthetic peptide
  Seed: TTEVISTAPVQMPTAESTGMT (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGMT

SEQ ID NO: 339298 - protein, 22 aa, Artificial Sequence
  Description of Artificial Sequence: Synthetic peptide
  Seed: TTEVISTAPVQMPTAESTGMTP (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGMTP

SEQ ID NO: 339299 - protein, 22 aa, Artificial Sequence
  Description of Artificial Sequence: Synthetic peptide
  Seed: TTEVISTAPVQMPTAESTGMTP (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGMTP

SEQ ID NO: 339300 - protein, 22 aa, Artificial Sequence
  Description of Artificial Sequence: Synthetic peptide
  Seed: TTEVISTAPVQMPTAESTGMTP (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGMTP

SEQ ID NO: 339301 - protein, 23 aa, Artificial Sequence
  Description of Artificial Sequence: Synthetic peptide
  Seed: TTEVISTAPVQMPTAESTGMTPE (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGMTPE

SEQ ID NO: 339302 - protein, 23 aa, Artificial Sequence
  Description of Artificial Sequence: Synthetic peptide
  Seed: TTEVISTAPVQMPTAESTGMTPE (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGMTPE

SEQ ID NO: 339303 - protein, 23 aa, Artificial Sequence
  Description of Artificial Sequence: Synthetic peptide
  Seed: TTEVISTAPVQMPTAESTGMTPE (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGMTPE

SEQ ID NO: 339304 - protein, 24 aa, Artificial Sequence
  Description of Artificial Sequence: Synthetic peptide
  Seed: TTEVISTAPVQMPTAESTGMTPEK (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGMTPEK

SEQ ID NO: 339305 - protein, 24 aa, Artificial Sequence
  Description of Artificial Sequence: Synthetic peptide
  Seed: TTEVISTAPVQMPTAESTGMTPEK (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGMTPEK

SEQ ID NO: 339306 - protein, 24 aa, Artificial Sequence
  Description of Artificial Sequence: Synthetic peptide
  Seed: TTEVISTAPVQMPTAESTGMTPEK (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGMTPEK

SEQ ID NO: 339307 - protein, 25 aa, Artificial Sequence
  Description of Artificial Sequence: Synthetic peptide
  Seed: TTEVISTAPVQMPTAESTGMTPEKV (PMEL_HUMAN)
  Core: VISTAPVQM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXISXAXVQXPTAESTGMTPEKV

SEQ ID NO: 339308 - protein, 25 aa, Artificial Sequence
  Description of Artificial Sequence: Synthetic peptide
  Seed: TTEVISTAPVQMPTAESTGMTPEKV (PMEL_HUMAN)
  Core: ISTAPVQMP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTEVXSTXPXQMXTAESTGMTPEKV

SEQ ID NO: 339309 - protein, 25 aa, Artificial Sequence
  Description of Artificial Sequence: Synthetic peptide
  Seed: TTEVISTAPVQMPTAESTGMTPEKV (PMEL_HUMAN)
  Core: PVQMPTAES
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTEVISTAXVQXPXAEXTGMTPEKV

SEQ ID NO: 339310 - protein, 14 aa, Artificial Sequence
  Description of Artificial Sequence: Synthetic peptide
  Seed: TTEVVGTTPGQAPT (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPT

SEQ ID NO: 339311 - protein, 15 aa, Artificial Sequence
  Description of Artificial Sequence: Synthetic peptide
  Seed: TTEVVGTTPGQAPTA (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTA

SEQ ID NO: 339312 - protein, 16 aa, Artificial Sequence
  Description of Artificial Sequence: Synthetic peptide
  Seed: TTEVVGTTPGQAPTAE (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAE

SEQ ID NO: 339313 - protein, 17 aa, Artificial Sequence
  Description of Artificial Sequence: Synthetic peptide
  Seed: TTEVVGTTPGQAPTAEP (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEP

SEQ ID NO: 339314 - protein, 18 aa, Artificial Sequence
  Description of Artificial Sequence: Synthetic peptide
  Seed: TTEVVGTTPGQAPTAEPS (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPS

SEQ ID NO: 339315 - protein, 18 aa, Artificial Sequence
  Description of Artificial Sequence: Synthetic peptide
  Seed: TTEVVGTTPGQAPTAEPS (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPS

SEQ ID NO: 339316 - protein, 19 aa, Artificial Sequence
  Description of Artificial Sequence: Synthetic peptide
  Seed: TTEVVGTTPGQAPTAEPSG (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSG

SEQ ID NO: 339317 - protein, 19 aa, Artificial Sequence
  Description of Artificial Sequence: Synthetic peptide
  Seed: TTEVVGTTPGQAPTAEPSG (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSG

SEQ ID NO: 339318 - protein, 20 aa, Artificial Sequence
  Description of Artificial Sequence: Synthetic peptide
  Seed: TTEVVGTTPGQAPTAEPSGT (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGT

SEQ ID NO: 339319 - protein, 20 aa, Artificial Sequence
  Description of Artificial Sequence: Synthetic peptide
  Seed: TTEVVGTTPGQAPTAEPSGT (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGT

SEQ ID NO: 339320 - protein, 21 aa, Artificial Sequence
  Description of Artificial Sequence: Synthetic peptide
  Seed: TTEVVGTTPGQAPTAEPSGTT (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGTT

SEQ ID NO: 339321 - protein, 21 aa, Artificial Sequence
  Description of Artificial Sequence: Synthetic peptide
  Seed: TTEVVGTTPGQAPTAEPSGTT (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGTT

SEQ ID NO: 339322 - protein, 22 aa, Artificial Sequence
  Description of Artificial Sequence: Synthetic peptide
  Seed: TTEVVGTTPGQAPTAEPSGTTS (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGTTS

SEQ ID NO: 339323 - protein, 22 aa, Artificial Sequence
  Description of Artificial Sequence: Synthetic peptide
  Seed: TTEVVGTTPGQAPTAEPSGTTS (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGTTS

SEQ ID NO: 339324 - protein, 23 aa, Artificial Sequence
  Description of Artificial Sequence: Synthetic peptide
  Seed: TTEVVGTTPGQAPTAEPSGTTSV (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGTTSV

SEQ ID NO: 339325 - protein, 23 aa, Artificial Sequence
  Description of Artificial Sequence: Synthetic peptide
  Seed: TTEVVGTTPGQAPTAEPSGTTSV (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGTTSV

SEQ ID NO: 339326 - protein, 24 aa, Artificial Sequence
  Description of Artificial Sequence: Synthetic peptide
  Seed: TTEVVGTTPGQAPTAEPSGTTSVQ (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGTTSVQ

SEQ ID NO: 339327 - protein, 24 aa, Artificial Sequence
  Description of Artificial Sequence: Synthetic peptide
  Seed: TTEVVGTTPGQAPTAEPSGTTSVQ (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGTTSVQ

SEQ ID NO: 339328 - protein, 25 aa, Artificial Sequence
  Description of Artificial Sequence: Synthetic peptide
  Seed: TTEVVGTTPGQAPTAEPSGTTSVQV (PMEL_HUMAN)
  Core: VVGTTPGQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVGXTXGQXPTAEPSGTTSVQV

SEQ ID NO: 339329 - protein, 25 aa, Artificial Sequence
  Description of Artificial Sequence: Synthetic peptide
  Seed: TTEVVGTTPGQAPTAEPSGTTSVQV (PMEL_HUMAN)
  Core: TTPGQAPTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTEVVGXTPXQXPTXEPSGTTSVQV

SEQ ID NO: 339330 - protein, 13 aa, Artificial Sequence
  Description of Artificial Sequence: Synthetic peptide
  Seed: TTEWVETTARELP (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXP

SEQ ID NO: 339331 - protein, 14 aa, Artificial Sequence
  Description of Artificial Sequence: Synthetic peptide
  Seed: TTEWVETTARELPI (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPI

SEQ ID NO: 339332 - protein, 15 aa, Artificial Sequence
  Description of Artificial Sequence: Synthetic peptide
  Seed: TTEWVETTARELPIP (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIP

SEQ ID NO: 339333 - protein, 16 aa, Artificial Sequence
  Description of Artificial Sequence: Synthetic peptide
  Seed: TTEWVETTARELPIPE (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPE

SEQ ID NO: 339334 - protein, 17 aa, Artificial Sequence
  Description of Artificial Sequence: Synthetic peptide
  Seed: TTEWVETTARELPIPEP (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEP

SEQ ID NO: 339335 - protein, 18 aa, Artificial Sequence
  Description of Artificial Sequence: Synthetic peptide
  Seed: TTEWVETTARELPIPEPE (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPE

SEQ ID NO: 339336 - protein, 19 aa, Artificial Sequence
  Description of Artificial Sequence: Synthetic peptide
  Seed: TTEWVETTARELPIPEPEG (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEG

SEQ ID NO: 339337 - protein, 20 aa, Artificial Sequence
  Description of Artificial Sequence: Synthetic peptide
  Seed: TTEWVETTARELPIPEPEGP (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGP

SEQ ID NO: 339338 - protein, 21 aa, Artificial Sequence
  Description of Artificial Sequence: Synthetic peptide
  Seed: TTEWVETTARELPIPEPEGPD (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGPD

SEQ ID NO: 339339 - protein, 22 aa, Artificial Sequence
  Description of Artificial Sequence: Synthetic peptide
  Seed: TTEWVETTARELPIPEPEGPDA (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGPDA

SEQ ID NO: 339340 - protein, 23 aa, Artificial Sequence
  Description of Artificial Sequence: Synthetic peptide
  Seed: TTEWVETTARELPIPEPEGPDAS (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGPDAS

SEQ ID NO: 339341 - protein, 24 aa, Artificial Sequence
  Description of Artificial Sequence: Synthetic peptide
  Seed: TTEWVETTARELPIPEPEGPDASS (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGPDASS

SEQ ID NO: 339342 - protein, 25 aa, Artificial Sequence
  Description of Artificial Sequence: Synthetic peptide
  Seed: TTEWVETTARELPIPEPEGPDASSI (PMEL_HUMAN)
  Core: WVETTAREL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTEXVEXTXREXPIPEPEGPDASSI

SEQ ID NO: 339343 - protein, 13 aa, Artificial Sequence
  Description of Artificial Sequence: Synthetic peptide
  Seed: TTLAEMSTPEATG (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXG

SEQ ID NO: 339344 - protein, 14 aa, Artificial Sequence
  Description of Artificial Sequence: Synthetic peptide
  Seed: TTLAEMSTPEATGM (PMEL_HUMAN)
  Core: LAEMSTPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TTXAEXSXPEXTGM

SEQ ID NO: 339345 - protein, 14 aa, Artificial Sequence
  Description of Artificial Sequence: Synthetic peptide
  Seed: TTLAEMSTPEATGM (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGM

SEQ ID NO: 339346 - protein, 15 aa, Artificial Sequence
  Description of Artificial Sequence: Synthetic peptide
  Seed: TTLAEMSTPEATGMT (PMEL_HUMAN)
  Core: LAEMSTPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TTXAEXSXPEXTGMT

SEQ ID NO: 339347 - protein, 15 aa, Artificial Sequence
  Description of Artificial Sequence: Synthetic peptide
  Seed: TTLAEMSTPEATGMT (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMT

SEQ ID NO: 339348 - protein, 16 aa, Artificial Sequence
  Description of Artificial Sequence: Synthetic peptide
  Seed: TTLAEMSTPEATGMTP (PMEL_HUMAN)
  Core: LAEMSTPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TTXAEXSXPEXTGMTP

SEQ ID NO: 339349 - protein, 16 aa, Artificial Sequence
  Description of Artificial Sequence: Synthetic peptide
  Seed: TTLAEMSTPEATGMTP (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMTP

SEQ ID NO: 339350 - protein, 17 aa, Artificial Sequence
  Description of Artificial Sequence: Synthetic peptide
  Seed: TTLAEMSTPEATGMTPA (PMEL_HUMAN)
  Core: LAEMSTPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TTXAEXSXPEXTGMTPA

SEQ ID NO: 339351 - protein, 17 aa, Artificial Sequence
  Description of Artificial Sequence: Synthetic peptide
  Seed: TTLAEMSTPEATGMTPA (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMTPA

SEQ ID NO: 339352 - protein, 18 aa, Artificial Sequence
  Description of Artificial Sequence: Synthetic peptide
  Seed: TTLAEMSTPEATGMTPAE (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMTPAE

SEQ ID NO: 339353 - protein, 19 aa, Artificial Sequence
  Description of Artificial Sequence: Synthetic peptide
  Seed: TTLAEMSTPEATGMTPAEV (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMTPAEV

SEQ ID NO: 339354 - protein, 19 aa, Artificial Sequence
  Description of Artificial Sequence: Synthetic peptide
  Seed: TTLAEMSTPEATGMTPAEV (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEX

SEQ ID NO: 339355 - protein, 20 aa, Artificial Sequence
  Description of Artificial Sequence: Synthetic peptide
  Seed: TTLAEMSTPEATGMTPAEVS (PMEL_HUMAN)
  Core: LAEMSTPEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TTXAEXSXPEXTGMTPAEVS

SEQ ID NO: 339356 - protein, 20 aa, Artificial Sequence
  Description of Artificial Sequence: Synthetic peptide
  Seed: TTLAEMSTPEATGMTPAEVS (PMEL_HUMAN)
  Core: AEMSTPEAT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TTLXEMXTXEAXGMTPAEVS

SEQ ID NO: 339357 - protein, 20 aa, Artificial Sequence
  Description of Artificial Sequence: Synthetic peptide
  Seed: TTLAEMSTPEATGMTPAEVS (PMEL_HUMAN)
  Core: EATGMTPAE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPXATXMXPAXVS

SEQ ID NO: 339358 - protein, 20 aa, Artificial Sequence
  Description of Artificial Sequence: Synthetic peptide
  Seed: TTLAEMSTPEATGMTPAEVS (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXS

SEQ ID NO: 339359 - protein, 21 aa, Artificial Sequence
  Description of Artificial Sequence: Synthetic peptide
  Seed: TTLAEMSTPEATGMTPAEVSI (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXSI

SEQ ID NO: 339360 - protein, 22 aa, Artificial Sequence
  Description of Artificial Sequence: Synthetic peptide
  Seed: TTLAEMSTPEATGMTPAEVSIV (PMEL_HUMAN)
  Core: EATGMTPAE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPXATXMXPAXVSIV

SEQ ID NO: 339361 - protein, 22 aa, Artificial Sequence
  Description of Artificial Sequence: Synthetic peptide
  Seed: TTLAEMSTPEATGMTPAEVSIV (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXSIV

SEQ ID NO: 339362 - protein, 23 aa, Artificial Sequence
  Description of Artificial Sequence: Synthetic peptide
  Seed: TTLAEMSTPEATGMTPAEVSIVV (PMEL_HUMAN)
  Core: EATGMTPAE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPXATXMXPAXVSIVV

SEQ ID NO: 339363 - protein, 23 aa, Artificial Sequence
  Description of Artificial Sequence: Synthetic peptide
  Seed: TTLAEMSTPEATGMTPAEVSIVV (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXSIVV

SEQ ID NO: 339364 - protein, 24 aa, Artificial Sequence
  Description of Artificial Sequence: Synthetic peptide
  Seed: TTLAEMSTPEATGMTPAEVSIVVL (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXSIVVL

SEQ ID NO: 339365 - protein, 24 aa, Artificial Sequence
  Description of Artificial Sequence: Synthetic peptide
  Seed: TTLAEMSTPEATGMTPAEVSIVVL (PMEL_HUMAN)
  Core: MTPAEVSIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEATGXTPXEXSIXVL

SEQ ID NO: 339366 - protein, 25 aa, Artificial Sequence
  Description of Artificial Sequence: Synthetic peptide
  Seed: TTLAEMSTPEATGMTPAEVSIVVLS (PMEL_HUMAN)
  Core: ATGMTPAEV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEXTGXTXAEXSIVVLS

SEQ ID NO: 339367 - protein, 25 aa, Artificial Sequence
  Description of Artificial Sequence: Synthetic peptide
  Seed: TTLAEMSTPEATGMTPAEVSIVVLS (PMEL_HUMAN)
  Core: MTPAEVSIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TTLAEMSTPEATGXTPXEXSIXVLS

SEQ ID NO: 339368 - protein, 15 aa, Artificial Sequence
  Description of Artificial Sequence: Synthetic peptide
  Seed: TTPGQAPTAEPSGTT (PMEL_HUMAN)
  Core: APTAEPSGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQXPTXEXSGXT

SEQ ID NO: 339369 - protein, 19 aa, Artificial Sequence
  Description of Artificial Sequence: Synthetic peptide
  Seed: TTPGQAPTAEPSGTTSVQV (PMEL_HUMAN)
  Core: APTAEPSGT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQXPTXEXSGXTSVQV

SEQ ID NO: 339370 - protein, 20 aa, Artificial Sequence
  Description of Artificial Sequence: Synthetic peptide
  Seed: TTPGQAPTAEPSGTTSVQVP (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXP

SEQ ID NO: 339371 - protein, 21 aa, Artificial Sequence
  Description of Artificial Sequence: Synthetic peptide
  Seed: TTPGQAPTAEPSGTTSVQVPT (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXPT

SEQ ID NO: 339372 - protein, 22 aa, Artificial Sequence
  Description of Artificial Sequence: Synthetic peptide
  Seed: TTPGQAPTAEPSGTTSVQVPTT (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXPTT

SEQ ID NO: 339373 - protein, 23 aa, Artificial Sequence
  Description of Artificial Sequence: Synthetic peptide
  Seed: TTPGQAPTAEPSGTTSVQVPTTE (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXPTTE

SEQ ID NO: 339374 - protein, 24 aa, Artificial Sequence
  Description of Artificial Sequence: Synthetic peptide
  Seed: TTPGQAPTAEPSGTTSVQVPTTEV (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXPTTEV

SEQ ID NO: 339375 - protein, 25 aa, Artificial Sequence
  Description of Artificial Sequence: Synthetic peptide
  Seed: TTPGQAPTAEPSGTTSVQVPTTEVI (PMEL_HUMAN)
  Core: PSGTTSVQV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTPGQAPTAEXSGXTXVQXPTTEVI

SEQ ID NO: 339376 - protein, 15 aa, Artificial Sequence
  Description of Artificial Sequence: Synthetic peptide
  Seed: TTSVQVPTTEVISTA (PMEL_HUMAN)
  Core: PTTEVISTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVXTTXVXSTX

SEQ ID NO: 339377 - protein, 16 aa, Artificial Sequence
  Description of Artificial Sequence: Synthetic peptide
  Seed: TTSVQVPTTEVISTAP (PMEL_HUMAN)
  Core: PTTEVISTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVXTTXVXSTXP

SEQ ID NO: 339378 - protein, 17 aa, Artificial Sequence
  Description of Artificial Sequence: Synthetic peptide
  Seed: TTSVQVPTTEVISTAPV (PMEL_HUMAN)
  Core: PTTEVISTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVXTTXVXSTXPV

SEQ ID NO: 339379 - protein, 19 aa, Artificial Sequence
  Description of Artificial Sequence: Synthetic peptide
  Seed: TTSVQVPTTEVISTAPVQM (PMEL_HUMAN)
  Core: PTTEVISTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVXTTXVXSTXPVQM

SEQ ID NO: 339380 - protein, 19 aa, Artificial Sequence
  Description of Artificial Sequence: Synthetic peptide
  Seed: TTSVQVPTTEVISTAPVQM (PMEL_HUMAN)
  Core: TEVISTAPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTXEVXSXAPXQM

SEQ ID NO: 339381 - protein, 19 aa, Artificial Sequence
  Description of Artificial Sequence: Synthetic peptide
  Seed: TTSVQVPTTEVISTAPVQM (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQX

SEQ ID NO: 339382 - protein, 20 aa, Artificial Sequence
  Description of Artificial Sequence: Synthetic peptide
  Seed: TTSVQVPTTEVISTAPVQMP (PMEL_HUMAN)
  Core: PTTEVISTA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVXTTXVXSTXPVQMP

SEQ ID NO: 339383 - protein, 20 aa, Artificial Sequence
  Description of Artificial Sequence: Synthetic peptide
  Seed: TTSVQVPTTEVISTAPVQMP (PMEL_HUMAN)
  Core: TEVISTAPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTXEVXSXAPXQMP

SEQ ID NO: 339384 - protein, 20 aa, Artificial Sequence
  Description of Artificial Sequence: Synthetic peptide
  Seed: TTSVQVPTTEVISTAPVQMP (PMEL_HUMAN)
  Core: EVISTAPVQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTXVIXTXPVXMP

SEQ ID NO: 339385 - protein, 20 aa, Artificial Sequence
  Description of Artificial Sequence: Synthetic peptide
  Seed: TTSVQVPTTEVISTAPVQMP (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXP

SEQ ID NO: 339386 - protein, 21 aa, Artificial Sequence
  Description of Artificial Sequence: Synthetic peptide
  Seed: TTSVQVPTTEVISTAPVQMPT (PMEL_HUMAN)
  Core: TEVISTAPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTXEVXSXAPXQMPT

SEQ ID NO: 339387 - protein, 21 aa, Artificial Sequence
  Description of Artificial Sequence: Synthetic peptide
  Seed: TTSVQVPTTEVISTAPVQMPT (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXPT

SEQ ID NO: 339388 - protein, 22 aa, Artificial Sequence
  Description of Artificial Sequence: Synthetic peptide
  Seed: TTSVQVPTTEVISTAPVQMPTA (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXPTA

SEQ ID NO: 339389 - protein, 22 aa, Artificial Sequence
  Description of Artificial Sequence: Synthetic peptide
  Seed: TTSVQVPTTEVISTAPVQMPTA (PMEL_HUMAN)
  Core: ISTAPVQMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEVXSTXPXQMXTA

SEQ ID NO: 339390 - protein, 23 aa, Artificial Sequence
  Description of Artificial Sequence: Synthetic peptide
  Seed: TTSVQVPTTEVISTAPVQMPTAE (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXPTAE

SEQ ID NO: 339391 - protein, 23 aa, Artificial Sequence
  Description of Artificial Sequence: Synthetic peptide
  Seed: TTSVQVPTTEVISTAPVQMPTAE (PMEL_HUMAN)
  Core: ISTAPVQMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEVXSTXPXQMXTAE

SEQ ID NO: 339392 - protein, 24 aa, Artificial Sequence
  Description of Artificial Sequence: Synthetic peptide
  Seed: TTSVQVPTTEVISTAPVQMPTAES (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXPTAES

SEQ ID NO: 339393 - protein, 24 aa, Artificial Sequence
  Description of Artificial Sequence: Synthetic peptide
  Seed: TTSVQVPTTEVISTAPVQMPTAES (PMEL_HUMAN)
  Core: ISTAPVQMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEVXSTXPXQMXTAES

SEQ ID NO: 339394 - protein, 25 aa, Artificial Sequence
  Description of Artificial Sequence: Synthetic peptide
  Seed: TTSVQVPTTEVISTAPVQMPTAEST (PMEL_HUMAN)
  Core: VISTAPVQM
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEXISXAXVQXPTAEST

SEQ ID NO: 339395 - protein, 25 aa, Artificial Sequence
  Description of Artificial Sequence: Synthetic peptide
  Seed: TTSVQVPTTEVISTAPVQMPTAEST (PMEL_HUMAN)
  Core: ISTAPVQMP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TTSVQVPTTEVXSTXPXQMXTAEST

SEQ ID NO: 339396 - protein, 13 aa, Artificial Sequence
  Description of Artificial Sequence: Synthetic peptide
  Seed: TTTEWVETTAREL (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREX

SEQ ID NO: 339397 - protein, 14 aa, Artificial Sequence
  Description of Artificial Sequence: Synthetic peptide
  Seed: TTTEWVETTARELP (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXP

SEQ ID NO: 339398 - protein, 15 aa, Artificial Sequence
  Description of Artificial Sequence: Synthetic peptide
  Seed: TTTEWVETTARELPI (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPI

SEQ ID NO: 339399 - protein, 16 aa, Artificial Sequence
  Description of Artificial Sequence: Synthetic peptide
  Seed: TTTEWVETTARELPIP (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIP

SEQ ID NO: 339400 - protein, 17 aa, Artificial Sequence
  Description of Artificial Sequence: Synthetic peptide
  Seed: TTTEWVETTARELPIPE (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPE

SEQ ID NO: 339401 - protein, 18 aa, Artificial Sequence
  Description of Artificial Sequence: Synthetic peptide
  Seed: TTTEWVETTARELPIPEP (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEP

SEQ ID NO: 339402 - protein, 19 aa, Artificial Sequence
  Description of Artificial Sequence: Synthetic peptide
  Seed: TTTEWVETTARELPIPEPE (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPE

SEQ ID NO: 339403 - protein, 20 aa, Artificial Sequence
  Description of Artificial Sequence: Synthetic peptide
  Seed: TTTEWVETTARELPIPEPEG (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEG

SEQ ID NO: 339404 - protein, 21 aa, Artificial Sequence
  Description of Artificial Sequence: Synthetic peptide
  Seed: TTTEWVETTARELPIPEPEGP (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEGP

SEQ ID NO: 339405 - protein, 22 aa, Artificial Sequence
  Description of Artificial Sequence: Synthetic peptide
  Seed: TTTEWVETTARELPIPEPEGPD (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEGPD

SEQ ID NO: 339406 - protein, 22 aa, Artificial Sequence
  Description of Artificial Sequence: Synthetic peptide
  Seed: TTTEWVETTARELPIPEPEGPD (PMEL_HUMAN)
  Core: RELPIPEPE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTTEWVETTAXELXIXEPXGPD

SEQ ID NO: 339407 - protein, 23 aa, Artificial Sequence
  Description of Artificial Sequence: Synthetic peptide
  Seed: TTTEWVETTARELPIPEPEGPDA (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEGPDA

SEQ ID NO: 339408 - protein, 23 aa, Artificial Sequence
  Description of Artificial Sequence: Synthetic peptide
  Seed: TTTEWVETTARELPIPEPEGPDA (PMEL_HUMAN)
  Core: RELPIPEPE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTTEWVETTAXELXIXEPXGPDA

SEQ ID NO: 339409 - protein, 24 aa, Artificial Sequence
  Description of Artificial Sequence: Synthetic peptide
  Seed: TTTEWVETTARELPIPEPEGPDAS (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEGPDAS

SEQ ID NO: 339410 - protein, 24 aa, Artificial Sequence
  Description of Artificial Sequence: Synthetic peptide
  Seed: TTTEWVETTARELPIPEPEGPDAS (PMEL_HUMAN)
  Core: RELPIPEPE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTTEWVETTAXELXIXEPXGPDAS

SEQ ID NO: 339411 - protein, 25 aa, Artificial Sequence
  Description of Artificial Sequence: Synthetic peptide
  Seed: TTTEWVETTARELPIPEPEGPDASS (PMEL_HUMAN)
  Core: WVETTAREL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TTTEXVEXTXREXPIPEPEGPDASS

SEQ ID NO: 339412 - protein, 25 aa, Artificial Sequence
  Description of Artificial Sequence: Synthetic peptide
  Seed: TTTEWVETTARELPIPEPEGPDASS (PMEL_HUMAN)
  Core: RELPIPEPE
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TTTEWVETTAXELXIXEPXGPDASS

SEQ ID NO: 339413 - protein, 13 aa, Artificial Sequence
  Description of Artificial Sequence: Synthetic peptide
  Seed: TVSCQGGLPKEAC (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXC

SEQ ID NO: 339414 - protein, 14 aa, Artificial Sequence
  Description of Artificial Sequence: Synthetic peptide
  Seed: TVSCQGGLPKEACM (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCM

SEQ ID NO: 339415 - protein, 15 aa, Artificial Sequence
  Description of Artificial Sequence: Synthetic peptide
  Seed: TVSCQGGLPKEACME (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCME

SEQ ID NO: 339416 - protein, 16 aa, Artificial Sequence
  Description of Artificial Sequence: Synthetic peptide
  Seed: TVSCQGGLPKEACMEI (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEI

SEQ ID NO: 339417 - protein, 17 aa, Artificial Sequence
  Description of Artificial Sequence: Synthetic peptide
  Seed: TVSCQGGLPKEACMEIS (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEIS

SEQ ID NO: 339418 - protein, 18 aa, Artificial Sequence
  Description of Artificial Sequence: Synthetic peptide
  Seed: TVSCQGGLPKEACMEISS (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISS

SEQ ID NO: 339419 - protein, 19 aa, Artificial Sequence
  Description of Artificial Sequence: Synthetic peptide
  Seed: TVSCQGGLPKEACMEISSP (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSP

SEQ ID NO: 339420 - protein, 20 aa, Artificial Sequence
  Description of Artificial Sequence: Synthetic peptide
  Seed: TVSCQGGLPKEACMEISSPG (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPG

SEQ ID NO: 339421 - protein, 21 aa, Artificial Sequence
  Description of Artificial Sequence: Synthetic peptide
  Seed: TVSCQGGLPKEACMEISSPGC (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPGC

SEQ ID NO: 339422 - protein, 22 aa, Artificial Sequence
  Description of Artificial Sequence: Synthetic peptide
  Seed: TVSCQGGLPKEACMEISSPGCQ (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPGCQ

SEQ ID NO: 339423 - protein, 23 aa, Artificial Sequence
  Description of Artificial Sequence: Synthetic peptide
  Seed: TVSCQGGLPKEACMEISSPGCQP (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPGCQP

SEQ ID NO: 339424 - protein, 24 aa, Artificial Sequence
  Description of Artificial Sequence: Synthetic peptide
  Seed: TVSCQGGLPKEACMEISSPGCQPP (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPGCQPP

SEQ ID NO: 339425 - protein, 25 aa, Artificial Sequence
  Description of Artificial Sequence: Synthetic peptide
  Seed: TVSCQGGLPKEACMEISSPGCQPPA (PMEL_HUMAN)
  Core: CQGGLPKEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TVSXQGXLXKEXCMEISSPGCQPPA

SEQ ID NO: 339426 - protein, 14 aa, Artificial Sequence
  Description of Artificial Sequence: Synthetic peptide
  Seed: TVYHRRGSRSYVPL (PMEL_HUMAN)
  Core: YHRRGSRSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TVXHRXGXRSXVPL

SEQ ID NO: 339427 - protein, 15 aa, Artificial Sequence
  Description of Artificial Sequence: Synthetic peptide
  Seed: TVYHRRGSRSYVPLA (PMEL_HUMAN)
  Core: YHRRGSRSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TVXHRXGXRSXVPLA

SEQ ID NO: 339428 - protein, 15 aa, Artificial Sequence
  Description of Artificial Sequence: Synthetic peptide
  Seed: TVYHRRGSRSYVPLA (PMEL_HUMAN)
  Core: RRGSRSYVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TVYHXRGXRXYVXLA

SEQ ID NO: 339429 - protein, 15 aa, Artificial Sequence
  Description of Artificial Sequence: Synthetic peptide
  Seed: TVYHRRGSRSYVPLA (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLX

SEQ ID NO: 339430 - protein, 16 aa, Artificial Sequence
  Description of Artificial Sequence: Synthetic peptide
  Seed: TVYHRRGSRSYVPLAH (PMEL_HUMAN)
  Core: YHRRGSRSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TVXHRXGXRSXVPLAH

SEQ ID NO: 339431 - protein, 16 aa, Artificial Sequence
  Description of Artificial Sequence: Synthetic peptide
  Seed: TVYHRRGSRSYVPLAH (PMEL_HUMAN)
  Core: RRGSRSYVP
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TVYHXRGXRXYVXLAH

SEQ ID NO: 339432 - protein, 16 aa, Artificial Sequence
  Description of Artificial Sequence: Synthetic peptide
  Seed: TVYHRRGSRSYVPLAH (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXH

SEQ ID NO: 339433 - protein, 17 aa, Artificial Sequence
  Description of Artificial Sequence: Synthetic peptide
  Seed: TVYHRRGSRSYVPLAHS (PMEL_HUMAN)
  Core: YHRRGSRSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TVXHRXGXRSXVPLAHS

SEQ ID NO: 339434 - protein, 17 aa, Artificial Sequence
  Description of Artificial Sequence: Synthetic peptide
  Seed: TVYHRRGSRSYVPLAHS (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHS

SEQ ID NO: 339435 - protein, 17 aa, Artificial Sequence
  Description of Artificial Sequence: Synthetic peptide
  Seed: TVYHRRGSRSYVPLAHS (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXS

SEQ ID NO: 339436 - protein, 17 aa, Artificial Sequence
  Description of Artificial Sequence: Synthetic peptide
  Seed: TVYHRRGSRSYVPLAHS (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHX

SEQ ID NO: 339437 - protein, 18 aa, Artificial Sequence
  Description of Artificial Sequence: Synthetic peptide
  Seed: TVYHRRGSRSYVPLAHSS (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSS

SEQ ID NO: 339438 - protein, 18 aa, Artificial Sequence
  Description of Artificial Sequence: Synthetic peptide
  Seed: TVYHRRGSRSYVPLAHSS (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXS

SEQ ID NO: 339439 - protein, 19 aa, Artificial Sequence
  Description of Artificial Sequence: Synthetic peptide
  Seed: TVYHRRGSRSYVPLAHSSS (PMEL_HUMAN)
  Core: YHRRGSRSY
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TVXHRXGXRSXVPLAHSSS

SEQ ID NO: 339440 - protein, 19 aa, Artificial Sequence
  Description of Artificial Sequence: Synthetic peptide
  Seed: TVYHRRGSRSYVPLAHSSS (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSS

SEQ ID NO: 339441 - protein, 19 aa, Artificial Sequence
  Description of Artificial Sequence: Synthetic peptide
  Seed: TVYHRRGSRSYVPLAHSSS (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSS

SEQ ID NO: 339442 - protein, 19 aa, Artificial Sequence
  Description of Artificial Sequence: Synthetic peptide
  Seed: TVYHRRGSRSYVPLAHSSS (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSS

SEQ ID NO: 339443 - protein, 19 aa, Artificial Sequence
  Description of Artificial Sequence: Synthetic peptide
  Seed: TVYHRRGSRSYVPLAHSSS (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSX

SEQ ID NO: 339444 - protein, 20 aa, Artificial Sequence
  Description of Artificial Sequence: Synthetic peptide
  Seed: TVYHRRGSRSYVPLAHSSSA (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSSA

SEQ ID NO: 339445 - protein, 20 aa, Artificial Sequence
  Description of Artificial Sequence: Synthetic peptide
  Seed: TVYHRRGSRSYVPLAHSSSA (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSA

SEQ ID NO: 339446 - protein, 20 aa, Artificial Sequence
  Description of Artificial Sequence: Synthetic peptide
  Seed: TVYHRRGSRSYVPLAHSSSA (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSA

SEQ ID NO: 339447 - protein, 20 aa, Artificial Sequence
  Description of Artificial Sequence: Synthetic peptide
  Seed: TVYHRRGSRSYVPLAHSSSA (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXA

SEQ ID NO: 339448 - protein, 21 aa, Artificial Sequence
  Description of Artificial Sequence: Synthetic peptide
  Seed: TVYHRRGSRSYVPLAHSSSAF (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSSAF

SEQ ID NO: 339449 - protein, 21 aa, Artificial Sequence
  Description of Artificial Sequence: Synthetic peptide
  Seed: TVYHRRGSRSYVPLAHSSSAF (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSAF

SEQ ID NO: 339450 - protein, 21 aa, Artificial Sequence
  Description of Artificial Sequence: Synthetic peptide
  Seed: TVYHRRGSRSYVPLAHSSSAF (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSAF

SEQ ID NO: 339451 - protein, 21 aa, Artificial Sequence
  Description of Artificial Sequence: Synthetic peptide
  Seed: TVYHRRGSRSYVPLAHSSSAF (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXAF

SEQ ID NO: 339452 - protein, 22 aa, Artificial Sequence
  Description of Artificial Sequence: Synthetic peptide
  Seed: TVYHRRGSRSYVPLAHSSSAFT (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSSAFT

SEQ ID NO: 339453 - protein, 22 aa, Artificial Sequence
  Description of Artificial Sequence: Synthetic peptide
  Seed: TVYHRRGSRSYVPLAHSSSAFT (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSAFT

SEQ ID NO: 339454 - protein, 22 aa, Artificial Sequence
  Description of Artificial Sequence: Synthetic peptide
  Seed: TVYHRRGSRSYVPLAHSSSAFT (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSAFT

SEQ ID NO: 339455 - protein, 22 aa, Artificial Sequence
  Description of Artificial Sequence: Synthetic peptide
  Seed: TVYHRRGSRSYVPLAHSSSAFT (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXAFT

SEQ ID NO: 339456 - protein, 23 aa, Artificial Sequence
  Description of Artificial Sequence: Synthetic peptide
  Seed: TVYHRRGSRSYVPLAHSSSAFTI (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSSAFTI

SEQ ID NO: 339457 - protein, 23 aa, Artificial Sequence
  Description of Artificial Sequence: Synthetic peptide
  Seed: TVYHRRGSRSYVPLAHSSSAFTI (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSAFTI

SEQ ID NO: 339458 - protein, 23 aa, Artificial Sequence
  Description of Artificial Sequence: Synthetic peptide
  Seed: TVYHRRGSRSYVPLAHSSSAFTI (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSAFTI

SEQ ID NO: 339459 - protein, 23 aa, Artificial Sequence
  Description of Artificial Sequence: Synthetic peptide
  Seed: TVYHRRGSRSYVPLAHSSSAFTI (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXAFTI

SEQ ID NO: 339460 - protein, 23 aa, Artificial Sequence
  Description of Artificial Sequence: Synthetic peptide
  Seed: TVYHRRGSRSYVPLAHSSSAFTI (PMEL_HUMAN)
  Core: LAHSSSAFT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSYVPXAHXSXAFXI

SEQ ID NO: 339461 - protein, 24 aa, Artificial Sequence
  Description of Artificial Sequence: Synthetic peptide
  Seed: TVYHRRGSRSYVPLAHSSSAFTIT (PMEL_HUMAN)
  Core: GSRSYVPLA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRXSRXYXPLXHSSSAFTIT

SEQ ID NO: 339462 - protein, 24 aa, Artificial Sequence
  Description of Artificial Sequence: Synthetic peptide
  Seed: TVYHRRGSRSYVPLAHSSSAFTIT (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSAFTIT

SEQ ID NO: 339463 - protein, 24 aa, Artificial Sequence
  Description of Artificial Sequence: Synthetic peptide
  Seed: TVYHRRGSRSYVPLAHSSSAFTIT (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSAFTIT

SEQ ID NO: 339464 - protein, 24 aa, Artificial Sequence
  Description of Artificial Sequence: Synthetic peptide
  Seed: TVYHRRGSRSYVPLAHSSSAFTIT (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXAFTIT

SEQ ID NO: 339465 - protein, 24 aa, Artificial Sequence
  Description of Artificial Sequence: Synthetic peptide
  Seed: TVYHRRGSRSYVPLAHSSSAFTIT (PMEL_HUMAN)
  Core: LAHSSSAFT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSYVPXAHXSXAFXIT

SEQ ID NO: 339466 - protein, 24 aa, Artificial Sequence
  Description of Artificial Sequence: Synthetic peptide
  Seed: TVYHRRGSRSYVPLAHSSSAFTIT (PMEL_HUMAN)
  Core: AHSSSAFTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSYVPLXHSXSXFTXT

SEQ ID NO: 339467 - protein, 25 aa, Artificial Sequence
  Description of Artificial Sequence: Synthetic peptide
  Seed: TVYHRRGSRSYVPLAHSSSAFTITD (PMEL_HUMAN)
  Core: SRSYVPLAH
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGXRSXVXLAXSSSAFTITD

SEQ ID NO: 339468 - protein, 25 aa, Artificial Sequence
  Description of Artificial Sequence: Synthetic peptide
  Seed: TVYHRRGSRSYVPLAHSSSAFTITD (PMEL_HUMAN)
  Core: RSYVPLAHS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSXSYXPXAHXSSAFTITD

SEQ ID NO: 339469 - protein, 25 aa, Artificial Sequence
  Description of Artificial Sequence: Synthetic peptide
  Seed: TVYHRRGSRSYVPLAHSSSAFTITD (PMEL_HUMAN)
  Core: YVPLAHSSS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSXVPXAXSSXAFTITD

SEQ ID NO: 339470 - protein, 25 aa, Artificial Sequence
  Description of Artificial Sequence: Synthetic peptide
  Seed: TVYHRRGSRSYVPLAHSSSAFTITD (PMEL_HUMAN)
  Core: LAHSSSAFT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSYVPXAHXSXAFXITD

SEQ ID NO: 339471 - protein, 25 aa, Artificial Sequence
  Description of Artificial Sequence: Synthetic peptide
  Seed: TVYHRRGSRSYVPLAHSSSAFTITD (PMEL_HUMAN)
  Core: AHSSSAFTI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
TVYHRRGSRSYVPLXHSXSXFTXTD

SEQ ID NO: 339472 - protein, 14 aa, Artificial Sequence
  Description of Artificial Sequence: Synthetic peptide
  Seed: TWDFGDSSGTLISR (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSR

SEQ ID NO: 339473 - protein, 15 aa, Artificial Sequence
  Description of Artificial Sequence: Synthetic peptide
  Seed: TWDFGDSSGTLISRA (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRA

SEQ ID NO: 339474 - protein, 15 aa, Artificial Sequence
  Description of Artificial Sequence: Synthetic peptide
  Seed: TWDFGDSSGTLISRA (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRX

SEQ ID NO: 339475 - protein, 16 aa, Artificial Sequence
  Description of Artificial Sequence: Synthetic peptide
  Seed: TWDFGDSSGTLISRAL (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXL

SEQ ID NO: 339476 - protein, 17 aa, Artificial Sequence
  Description of Artificial Sequence: Synthetic peptide
  Seed: TWDFGDSSGTLISRALV (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALV

SEQ ID NO: 339477 - protein, 17 aa, Artificial Sequence
  Description of Artificial Sequence: Synthetic peptide
  Seed: TWDFGDSSGTLISRALV (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLV

SEQ ID NO: 339478 - protein, 18 aa, Artificial Sequence
  Description of Artificial Sequence: Synthetic peptide
  Seed: TWDFGDSSGTLISRALVV (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVV

SEQ ID NO: 339479 - protein, 19 aa, Artificial Sequence
  Description of Artificial Sequence: Synthetic peptide
  Seed: TWDFGDSSGTLISRALVVT (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVT

SEQ ID NO: 339480 - protein, 19 aa, Artificial Sequence
  Description of Artificial Sequence: Synthetic peptide
  Seed: TWDFGDSSGTLISRALVVT (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVT

SEQ ID NO: 339481 - protein, 19 aa, Artificial Sequence
  Description of Artificial Sequence: Synthetic peptide
  Seed: TWDFGDSSGTLISRALVVT (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVT

SEQ ID NO: 339482 - protein, 19 aa, Artificial Sequence
  Description of Artificial Sequence: Synthetic peptide
  Seed: TWDFGDSSGTLISRALVVT (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXT

SEQ ID NO: 339483 - protein, 19 aa, Artificial Sequence
  Description of Artificial Sequence: Synthetic peptide
  Seed: TWDFGDSSGTLISRALVVT (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVX

SEQ ID NO: 339484 - protein, 20 aa, Artificial Sequence
  Description of Artificial Sequence: Synthetic peptide
  Seed: TWDFGDSSGTLISRALVVTH (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTH

SEQ ID NO: 339485 - protein, 20 aa, Artificial Sequence
  Description of Artificial Sequence: Synthetic peptide
  Seed: TWDFGDSSGTLISRALVVTH (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTH

SEQ ID NO: 339486 - protein, 20 aa, Artificial Sequence
  Description of Artificial Sequence: Synthetic peptide
  Seed: TWDFGDSSGTLISRALVVTH (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTH

SEQ ID NO: 339487 - protein, 20 aa, Artificial Sequence
  Description of Artificial Sequence: Synthetic peptide
  Seed: TWDFGDSSGTLISRALVVTH (PMEL_HUMAN)
  Core: GTLISRALV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSXTLXSXALXVTH

SEQ ID NO: 339488 - protein, 20 aa, Artificial Sequence
  Description of Artificial Sequence: Synthetic peptide
  Seed: TWDFGDSSGTLISRALVVTH (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTH

SEQ ID NO: 339489 - protein, 20 aa, Artificial Sequence
  Description of Artificial Sequence: Synthetic peptide
  Seed: TWDFGDSSGTLISRALVVTH (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXH

SEQ ID NO: 339490 - protein, 21 aa, Artificial Sequence
  Description of Artificial Sequence: Synthetic peptide
  Seed: TWDFGDSSGTLISRALVVTHT (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTHT

SEQ ID NO: 339491 - protein, 21 aa, Artificial Sequence
  Description of Artificial Sequence: Synthetic peptide
  Seed: TWDFGDSSGTLISRALVVTHT (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTHT

SEQ ID NO: 339492 - protein, 21 aa, Artificial Sequence
  Description of Artificial Sequence: Synthetic peptide
  Seed: TWDFGDSSGTLISRALVVTHT (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTHT

SEQ ID NO: 339493 - protein, 21 aa, Artificial Sequence
  Description of Artificial Sequence: Synthetic peptide
  Seed: TWDFGDSSGTLISRALVVTHT (PMEL_HUMAN)
  Core: GTLISRALV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSXTLXSXALXVTHT

SEQ ID NO: 339494 - protein, 21 aa, Artificial Sequence
  Description of Artificial Sequence: Synthetic peptide
  Seed: TWDFGDSSGTLISRALVVTHT (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTHT

SEQ ID NO: 339495 - protein, 21 aa, Artificial Sequence
  Description of Artificial Sequence: Synthetic peptide
  Seed: TWDFGDSSGTLISRALVVTHT (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXHT

SEQ ID NO: 339496 - protein, 22 aa, Artificial Sequence
  Description of Artificial Sequence: Synthetic peptide
  Seed: TWDFGDSSGTLISRALVVTHTY (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTHTY

SEQ ID NO: 339497 - protein, 22 aa, Artificial Sequence
  Description of Artificial Sequence: Synthetic peptide
  Seed: TWDFGDSSGTLISRALVVTHTY (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTHTY

SEQ ID NO: 339498 - protein, 22 aa, Artificial Sequence
  Description of Artificial Sequence: Synthetic peptide
  Seed: TWDFGDSSGTLISRALVVTHTY (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTHTY

SEQ ID NO: 339499 - protein, 22 aa, Artificial Sequence
  Description of Artificial Sequence: Synthetic peptide
  Seed: TWDFGDSSGTLISRALVVTHTY (PMEL_HUMAN)
  Core: GTLISRALV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSXTLXSXALXVTHTY

SEQ ID NO: 339500 - protein, 22 aa, Artificial Sequence
  Description of Artificial Sequence: Synthetic peptide
  Seed: TWDFGDSSGTLISRALVVTHTY (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTHTY

SEQ ID NO: 339501 - protein, 22 aa, Artificial Sequence
  Description of Artificial Sequence: Synthetic peptide
  Seed: TWDFGDSSGTLISRALVVTHTY (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXHTY

SEQ ID NO: 339502 - protein, 22 aa, Artificial Sequence
  Description of Artificial Sequence: Synthetic peptide
  Seed: TWDFGDSSGTLISRALVVTHTY (PMEL_HUMAN)
  Core: ISRALVVTH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLXSRXLXVTXTY

SEQ ID NO: 339503 - protein, 23 aa, Artificial Sequence
  Description of Artificial Sequence: Synthetic peptide
  Seed: TWDFGDSSGTLISRALVVTHTYL (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTHTYL

SEQ ID NO: 339504 - protein, 23 aa, Artificial Sequence
  Description of Artificial Sequence: Synthetic peptide
  Seed: TWDFGDSSGTLISRALVVTHTYL (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTHTYL

SEQ ID NO: 339505 - protein, 23 aa, Artificial Sequence
  Description of Artificial Sequence: Synthetic peptide
  Seed: TWDFGDSSGTLISRALVVTHTYL (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTHTYL

SEQ ID NO: 339506 - protein, 23 aa, Artificial Sequence
  Description of Artificial Sequence: Synthetic peptide
  Seed: TWDFGDSSGTLISRALVVTHTYL (PMEL_HUMAN)
  Core: GTLISRALV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSXTLXSXALXVTHTYL

SEQ ID NO: 339507 - protein, 23 aa, Artificial Sequence
  Description of Artificial Sequence: Synthetic peptide
  Seed: TWDFGDSSGTLISRALVVTHTYL (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTHTYL

SEQ ID NO: 339508 - protein, 23 aa, Artificial Sequence
  Description of Artificial Sequence: Synthetic peptide
  Seed: TWDFGDSSGTLISRALVVTHTYL (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXHTYL

SEQ ID NO: 339509 - protein, 23 aa, Artificial Sequence
  Description of Artificial Sequence: Synthetic peptide
  Seed: TWDFGDSSGTLISRALVVTHTYL (PMEL_HUMAN)
  Core: ISRALVVTH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLXSRXLXVTXTYL

SEQ ID NO: 339510 - protein, 23 aa, Artificial Sequence
  Description of Artificial Sequence: Synthetic peptide
  Seed: TWDFGDSSGTLISRALVVTHTYL (PMEL_HUMAN)
  Core: SRALVVTHT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLIXRAXVXTHXYL

SEQ ID NO: 339511 - protein, 24 aa, Artificial Sequence
  Description of Artificial Sequence: Synthetic peptide
  Seed: TWDFGDSSGTLISRALVVTHTYLE (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTHTYLE

SEQ ID NO: 339512 - protein, 24 aa, Artificial Sequence
  Description of Artificial Sequence: Synthetic peptide
  Seed: TWDFGDSSGTLISRALVVTHTYLE (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTHTYLE

SEQ ID NO: 339513 - protein, 24 aa, Artificial Sequence
  Description of Artificial Sequence: Synthetic peptide
  Seed: TWDFGDSSGTLISRALVVTHTYLE (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTHTYLE

SEQ ID NO: 339514 - protein, 24 aa, Artificial Sequence
  Description of Artificial Sequence: Synthetic peptide
  Seed: TWDFGDSSGTLISRALVVTHTYLE (PMEL_HUMAN)
  Core: GTLISRALV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSXTLXSXALXVTHTYLE

SEQ ID NO: 339515 - protein, 24 aa, Artificial Sequence
  Description of Artificial Sequence: Synthetic peptide
  Seed: TWDFGDSSGTLISRALVVTHTYLE (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTHTYLE

SEQ ID NO: 339516 - protein, 24 aa, Artificial Sequence
  Description of Artificial Sequence: Synthetic peptide
  Seed: TWDFGDSSGTLISRALVVTHTYLE (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXHTYLE

SEQ ID NO: 339517 - protein, 24 aa, Artificial Sequence
  Description of Artificial Sequence: Synthetic peptide
  Seed: TWDFGDSSGTLISRALVVTHTYLE (PMEL_HUMAN)
  Core: ISRALVVTH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLXSRXLXVTXTYLE

SEQ ID NO: 339518 - protein, 24 aa, Artificial Sequence
  Description of Artificial Sequence: Synthetic peptide
  Seed: TWDFGDSSGTLISRALVVTHTYLE (PMEL_HUMAN)
  Core: SRALVVTHT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLIXRAXVXTHXYLE

SEQ ID NO: 339519 - protein, 24 aa, Artificial Sequence
  Description of Artificial Sequence: Synthetic peptide
  Seed: TWDFGDSSGTLISRALVVTHTYLE (PMEL_HUMAN)
  Core: RALVVTHTY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLISXALXVXHTXLE

SEQ ID NO: 339520 - protein, 24 aa, Artificial Sequence
  Description of Artificial Sequence: Synthetic peptide
  Seed: TWDFGDSSGTLISRALVVTHTYLE (PMEL_HUMAN)
  Core: LVVTHTYLE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLISRAXVVXHXYLX

SEQ ID NO: 339521 - protein, 25 aa, Artificial Sequence
  Description of Artificial Sequence: Synthetic peptide
  Seed: TWDFGDSSGTLISRALVVTHTYLEP (PMEL_HUMAN)
  Core: FGDSSGTLI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TWDXGDXSXTLXSRALVVTHTYLEP

SEQ ID NO: 339522 - protein, 25 aa, Artificial Sequence
  Description of Artificial Sequence: Synthetic peptide
  Seed: TWDFGDSSGTLISRALVVTHTYLEP (PMEL_HUMAN)
  Core: SSGTLISRA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDXSGXLXSRXLVVTHTYLEP

SEQ ID NO: 339523 - protein, 25 aa, Artificial Sequence
  Description of Artificial Sequence: Synthetic peptide
  Seed: TWDFGDSSGTLISRALVVTHTYLEP (PMEL_HUMAN)
  Core: SGTLISRAL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSXGTXIXRAXVVTHTYLEP

SEQ ID NO: 339524 - protein, 25 aa, Artificial Sequence
  Description of Artificial Sequence: Synthetic peptide
  Seed: TWDFGDSSGTLISRALVVTHTYLEP (PMEL_HUMAN)
  Core: TLISRALVV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGXLIXRXLVXTHTYLEP

SEQ ID NO: 339525 - protein, 25 aa, Artificial Sequence
  Description of Artificial Sequence: Synthetic peptide
  Seed: TWDFGDSSGTLISRALVVTHTYLEP (PMEL_HUMAN)
  Core: LISRALVVT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTXISXAXVVXHTYLEP

SEQ ID NO: 339526 - protein, 25 aa, Artificial Sequence
  Description of Artificial Sequence: Synthetic peptide
  Seed: TWDFGDSSGTLISRALVVTHTYLEP (PMEL_HUMAN)
  Core: ISRALVVTH
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLXSRXLXVTXTYLEP

SEQ ID NO: 339527 - protein, 25 aa, Artificial Sequence
  Description of Artificial Sequence: Synthetic peptide
  Seed: TWDFGDSSGTLISRALVVTHTYLEP (PMEL_HUMAN)
  Core: SRALVVTHT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLIXRAXVXTHXYLEP

SEQ ID NO: 339528 - protein, 25 aa, Artificial Sequence
  Description of Artificial Sequence: Synthetic peptide
  Seed: TWDFGDSSGTLISRALVVTHTYLEP (PMEL_HUMAN)
  Core: RALVVTHTY
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLISXALXVXHTXLEP

SEQ ID NO: 339529 - protein, 25 aa, Artificial Sequence
  Description of Artificial Sequence: Synthetic peptide
  Seed: TWDFGDSSGTLISRALVVTHTYLEP (PMEL_HUMAN)
  Core: LVVTHTYLE
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
TWDFGDSSGTLISRAXVVXHXYLXP

SEQ ID NO: 339530 - protein, 13 aa, Artificial Sequence
  Description of Artificial Sequence: Synthetic peptide
  Seed: TWGQYWQVLGGPV (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPX

SEQ ID NO: 339531 - protein, 14 aa, Artificial Sequence
  Description of Artificial Sequence: Synthetic peptide
  Seed: TWGQYWQVLGGPVS (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXS

SEQ ID NO: 339532 - protein, 15 aa, Artificial Sequence
  Description of Artificial Sequence: Synthetic peptide
  Seed: TWGQYWQVLGGPVSG (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSG

SEQ ID NO: 339533 - protein, 15 aa, Artificial Sequence
  Description of Artificial Sequence: Synthetic peptide
  Seed: TWGQYWQVLGGPVSG (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXG

SEQ ID NO: 339534 - protein, 16 aa, Artificial Sequence
  Description of Artificial Sequence: Synthetic peptide
  Seed: TWGQYWQVLGGPVSGL (PMEL_HUMAN)
  Core: GQYWQVLGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TWXQYXQXLGXPVSGL

SEQ ID NO: 339535 - protein, 16 aa, Artificial Sequence
  Description of Artificial Sequence: Synthetic peptide
  Seed: TWGQYWQVLGGPVSGL (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGL

SEQ ID NO: 339536 - protein, 16 aa, Artificial Sequence
  Description of Artificial Sequence: Synthetic peptide
  Seed: TWGQYWQVLGGPVSGL (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGL

SEQ ID NO: 339537 - protein, 17 aa, Artificial Sequence
  Description of Artificial Sequence: Synthetic peptide
  Seed: TWGQYWQVLGGPVSGLS (PMEL_HUMAN)
  Core: GQYWQVLGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TWXQYXQXLGXPVSGLS

SEQ ID NO: 339538 - protein, 17 aa, Artificial Sequence
  Description of Artificial Sequence: Synthetic peptide
  Seed: TWGQYWQVLGGPVSGLS (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLS

SEQ ID NO: 339539 - protein, 17 aa, Artificial Sequence
  Description of Artificial Sequence: Synthetic peptide
  Seed: TWGQYWQVLGGPVSGLS (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLS

SEQ ID NO: 339540 - protein, 17 aa, Artificial Sequence
  Description of Artificial Sequence: Synthetic peptide
  Seed: TWGQYWQVLGGPVSGLS (PMEL_HUMAN)
  Core: VLGGPVSGL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQXLGXPXSGXS

SEQ ID NO: 339541 - protein, 18 aa, Artificial Sequence
  Description of Artificial Sequence: Synthetic peptide
  Seed: TWGQYWQVLGGPVSGLSI (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSI

SEQ ID NO: 339542 - protein, 18 aa, Artificial Sequence
  Description of Artificial Sequence: Synthetic peptide
  Seed: TWGQYWQVLGGPVSGLSI (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSI

SEQ ID NO: 339543 - protein, 18 aa, Artificial Sequence
  Description of Artificial Sequence: Synthetic peptide
  Seed: TWGQYWQVLGGPVSGLSI (PMEL_HUMAN)
  Core: VLGGPVSGL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQXLGXPXSGXSI

SEQ ID NO: 339544 - protein, 19 aa, Artificial Sequence
  Description of Artificial Sequence: Synthetic peptide
  Seed: TWGQYWQVLGGPVSGLSIG (PMEL_HUMAN)
  Core: GQYWQVLGG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TWXQYXQXLGXPVSGLSIG

SEQ ID NO: 339545 - protein, 19 aa, Artificial Sequence
  Description of Artificial Sequence: Synthetic peptide
  Seed: TWGQYWQVLGGPVSGLSIG (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIG

SEQ ID NO: 339546 - protein, 19 aa, Artificial Sequence
  Description of Artificial Sequence: Synthetic peptide
  Seed: TWGQYWQVLGGPVSGLSIG (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIG

SEQ ID NO: 339547 - protein, 19 aa, Artificial Sequence
  Description of Artificial Sequence: Synthetic peptide
  Seed: TWGQYWQVLGGPVSGLSIG (PMEL_HUMAN)
  Core: VLGGPVSGL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQXLGXPXSGXSIG

SEQ ID NO: 339548 - protein, 20 aa, Artificial Sequence
  Description of Artificial Sequence: Synthetic peptide
  Seed: TWGQYWQVLGGPVSGLSIGT (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGT

SEQ ID NO: 339549 - protein, 20 aa, Artificial Sequence
  Description of Artificial Sequence: Synthetic peptide
  Seed: TWGQYWQVLGGPVSGLSIGT (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGT

SEQ ID NO: 339550 - protein, 20 aa, Artificial Sequence
  Description of Artificial Sequence: Synthetic peptide
  Seed: TWGQYWQVLGGPVSGLSIGT (PMEL_HUMAN)
  Core: VLGGPVSGL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQXLGXPXSGXSIGT

SEQ ID NO: 339551 - protein, 21 aa, Artificial Sequence
  Description of Artificial Sequence: Synthetic peptide
  Seed: TWGQYWQVLGGPVSGLSIGTG (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGTG

SEQ ID NO: 339552 - protein, 21 aa, Artificial Sequence
  Description of Artificial Sequence: Synthetic peptide
  Seed: TWGQYWQVLGGPVSGLSIGTG (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGTG

SEQ ID NO: 339553 - protein, 21 aa, Artificial Sequence
  Description of Artificial Sequence: Synthetic peptide
  Seed: TWGQYWQVLGGPVSGLSIGTG (PMEL_HUMAN)
  Core: VLGGPVSGL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQXLGXPXSGXSIGTG

SEQ ID NO: 339554 - protein, 21 aa, Artificial Sequence
  Description of Artificial Sequence: Synthetic peptide
  Seed: TWGQYWQVLGGPVSGLSIGTG (PMEL_HUMAN)
  Core: PVSGLSIGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGXVSXLXIGXG

SEQ ID NO: 339555 - protein, 22 aa, Artificial Sequence
  Description of Artificial Sequence: Synthetic peptide
  Seed: TWGQYWQVLGGPVSGLSIGTGR (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGTGR

SEQ ID NO: 339556 - protein, 22 aa, Artificial Sequence
  Description of Artificial Sequence: Synthetic peptide
  Seed: TWGQYWQVLGGPVSGLSIGTGR (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGTGR

SEQ ID NO: 339557 - protein, 22 aa, Artificial Sequence
  Description of Artificial Sequence: Synthetic peptide
  Seed: TWGQYWQVLGGPVSGLSIGTGR (PMEL_HUMAN)
  Core: PVSGLSIGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGXVSXLXIGXGR

SEQ ID NO: 339558 - protein, 22 aa, Artificial Sequence
  Description of Artificial Sequence: Synthetic peptide
  Seed: TWGQYWQVLGGPVSGLSIGTGR (PMEL_HUMAN)
  Core: VSGLSIGTG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGPXSGXSXGTXR

SEQ ID NO: 339559 - protein, 23 aa, Artificial Sequence
  Description of Artificial Sequence: Synthetic peptide
  Seed: TWGQYWQVLGGPVSGLSIGTGRA (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGTGRA

SEQ ID NO: 339560 - protein, 23 aa, Artificial Sequence
  Description of Artificial Sequence: Synthetic peptide
  Seed: TWGQYWQVLGGPVSGLSIGTGRA (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGTGRA

SEQ ID NO: 339561 - protein, 23 aa, Artificial Sequence
  Description of Artificial Sequence: Synthetic peptide
  Seed: TWGQYWQVLGGPVSGLSIGTGRA (PMEL_HUMAN)
  Core: PVSGLSIGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGXVSXLXIGXGRA

SEQ ID NO: 339562 - protein, 23 aa, Artificial Sequence
  Description of Artificial Sequence: Synthetic peptide
  Seed: TWGQYWQVLGGPVSGLSIGTGRA (PMEL_HUMAN)
  Core: VSGLSIGTG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGPXSGXSXGTXRA

SEQ ID NO: 339563 - protein, 24 aa, Artificial Sequence
  Description of Artificial Sequence: Synthetic peptide
  Seed: TWGQYWQVLGGPVSGLSIGTGRAM (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGTGRAM

SEQ ID NO: 339564 - protein, 24 aa, Artificial Sequence
  Description of Artificial Sequence: Synthetic peptide
  Seed: TWGQYWQVLGGPVSGLSIGTGRAM (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGTGRAM

SEQ ID NO: 339565 - protein, 24 aa, Artificial Sequence
  Description of Artificial Sequence: Synthetic peptide
  Seed: TWGQYWQVLGGPVSGLSIGTGRAM (PMEL_HUMAN)
  Core: PVSGLSIGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGXVSXLXIGXGRAM

SEQ ID NO: 339566 - protein, 24 aa, Artificial Sequence
  Description of Artificial Sequence: Synthetic peptide
  Seed: TWGQYWQVLGGPVSGLSIGTGRAM (PMEL_HUMAN)
  Core: VSGLSIGTG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGPXSGXSXGTXRAM

SEQ ID NO: 339567 - protein, 25 aa, Artificial Sequence
  Description of Artificial Sequence: Synthetic peptide
  Seed: TWGQYWQVLGGPVSGLSIGTGRAML (PMEL_HUMAN)
  Core: YWQVLGGPV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TWGQXWQXLXGPXSGLSIGTGRAML

SEQ ID NO: 339568 - protein, 25 aa, Artificial Sequence
  Description of Artificial Sequence: Synthetic peptide
  Seed: TWGQYWQVLGGPVSGLSIGTGRAML (PMEL_HUMAN)
  Core: WQVLGGPVS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYXQVXGXPVXGLSIGTGRAML

SEQ ID NO: 339569 - protein, 25 aa, Artificial Sequence
  Description of Artificial Sequence: Synthetic peptide
  Seed: TWGQYWQVLGGPVSGLSIGTGRAML (PMEL_HUMAN)
  Core: PVSGLSIGT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGXVSXLXIGXGRAML

SEQ ID NO: 339570 - protein, 25 aa, Artificial Sequence
  Description of Artificial Sequence: Synthetic peptide
  Seed: TWGQYWQVLGGPVSGLSIGTGRAML (PMEL_HUMAN)
  Core: VSGLSIGTG
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
TWGQYWQVLGGPXSGXSXGTXRAML

SEQ ID NO: 339571 - protein, 14 aa, Artificial Sequence
  Description of Artificial Sequence: Synthetic peptide
  Seed: TYCLNVSLADTNSL (PMEL_HUMAN)
  Core: YCLNVSLAD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXCLXVXLAXTNSL

SEQ ID NO: 339572 - protein, 14 aa, Artificial Sequence
  Description of Artificial Sequence: Synthetic peptide
  Seed: TYCLNVSLADTNSL (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSL

SEQ ID NO: 339573 - protein, 15 aa, Artificial Sequence
  Description of Artificial Sequence: Synthetic peptide
  Seed: TYCLNVSLADTNSLA (PMEL_HUMAN)
  Core: YCLNVSLAD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXCLXVXLAXTNSLA

SEQ ID NO: 339574 - protein, 15 aa, Artificial Sequence
  Description of Artificial Sequence: Synthetic peptide
  Seed: TYCLNVSLADTNSLA (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLA

SEQ ID NO: 339575 - protein, 15 aa, Artificial Sequence
  Description of Artificial Sequence: Synthetic peptide
  Seed: TYCLNVSLADTNSLA (PMEL_HUMAN)
  Core: NVSLADTNS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYCLXVSXAXTNXLA

SEQ ID NO: 339576 - protein, 15 aa, Artificial Sequence
  Description of Artificial Sequence: Synthetic peptide
  Seed: TYCLNVSLADTNSLA (PMEL_HUMAN)
  Core: VSLADTNSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNXSLXDXNSXA

SEQ ID NO: 339577 - protein, 16 aa, Artificial Sequence
  Description of Artificial Sequence: Synthetic peptide
  Seed: TYCLNVSLADTNSLAV (PMEL_HUMAN)
  Core: YCLNVSLAD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXCLXVXLAXTNSLAV

SEQ ID NO: 339578 - protein, 16 aa, Artificial Sequence
  Description of Artificial Sequence: Synthetic peptide
  Seed: TYCLNVSLADTNSLAV (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAV

SEQ ID NO: 339579 - protein, 16 aa, Artificial Sequence
  Description of Artificial Sequence: Synthetic peptide
  Seed: TYCLNVSLADTNSLAV (PMEL_HUMAN)
  Core: NVSLADTNS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYCLXVSXAXTNXLAV

SEQ ID NO: 339580 - protein, 16 aa, Artificial Sequence
  Description of Artificial Sequence: Synthetic peptide
  Seed: TYCLNVSLADTNSLAV (PMEL_HUMAN)
  Core: VSLADTNSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNXSLXDXNSXAV

SEQ ID NO: 339581 - protein, 16 aa, Artificial Sequence
  Description of Artificial Sequence: Synthetic peptide
  Seed: TYCLNVSLADTNSLAV (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAX

SEQ ID NO: 339582 - protein, 17 aa, Artificial Sequence
  Description of Artificial Sequence: Synthetic peptide
  Seed: TYCLNVSLADTNSLAVV (PMEL_HUMAN)
  Core: YCLNVSLAD
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
TXCLXVXLAXTNSLAVV

SEQ ID NO: 339583 - protein, 17 aa, Artificial Sequence
  Description of Artificial Sequence: Synthetic peptide
  Seed: TYCLNVSLADTNSLAVV (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVV

SEQ ID NO: 339584 - protein, 17 aa, Artificial Sequence
  Description of Artificial Sequence: Synthetic peptide
  Seed: TYCLNVSLADTNSLAVV (PMEL_HUMAN)
  Core: VSLADTNSL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNXSLXDXNSXAVV

SEQ ID NO: 339585 - protein, 17 aa, Artificial Sequence
  Description of Artificial Sequence: Synthetic peptide
  Seed: TYCLNVSLADTNSLAVV (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXV

SEQ ID NO: 339586 - protein, 18 aa, Artificial Sequence
  Description of Artificial Sequence: Synthetic peptide
  Seed: TYCLNVSLADTNSLAVVS (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVS

SEQ ID NO: 339587 - protein, 19 aa, Artificial Sequence
  Description of Artificial Sequence: Synthetic peptide
  Seed: TYCLNVSLADTNSLAVVST (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVVST

SEQ ID NO: 339588 - protein, 19 aa, Artificial Sequence
  Description of Artificial Sequence: Synthetic peptide
  Seed: TYCLNVSLADTNSLAVVST (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVST

SEQ ID NO: 339589 - protein, 20 aa, Artificial Sequence
  Description of Artificial Sequence: Synthetic peptide
  Seed: TYCLNVSLADTNSLAVVSTQ (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVVSTQ

SEQ ID NO: 339590 - protein, 20 aa, Artificial Sequence
  Description of Artificial Sequence: Synthetic peptide
  Seed: TYCLNVSLADTNSLAVVSTQ (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQ

SEQ ID NO: 339591 - protein, 20 aa, Artificial Sequence
  Description of Artificial Sequence: Synthetic peptide
  Seed: TYCLNVSLADTNSLAVVSTQ (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQ

SEQ ID NO: 339592 - protein, 20 aa, Artificial Sequence
  Description of Artificial Sequence: Synthetic peptide
  Seed: TYCLNVSLADTNSLAVVSTQ (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTX

SEQ ID NO: 339593 - protein, 21 aa, Artificial Sequence
  Description of Artificial Sequence: Synthetic peptide
  Seed: TYCLNVSLADTNSLAVVSTQL (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVVSTQL

SEQ ID NO: 339594 - protein, 21 aa, Artificial Sequence
  Description of Artificial Sequence: Synthetic peptide
  Seed: TYCLNVSLADTNSLAVVSTQL (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQL

SEQ ID NO: 339595 - protein, 21 aa, Artificial Sequence
  Description of Artificial Sequence: Synthetic peptide
  Seed: TYCLNVSLADTNSLAVVSTQL (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQL

SEQ ID NO: 339596 - protein, 21 aa, Artificial Sequence
  Description of Artificial Sequence: Synthetic peptide
  Seed: TYCLNVSLADTNSLAVVSTQL (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTXL

SEQ ID NO: 339597 - protein, 22 aa, Artificial Sequence
  Description of Artificial Sequence: Synthetic peptide
  Seed: TYCLNVSLADTNSLAVVSTQLI (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVVSTQLI

SEQ ID NO: 339598 - protein, 22 aa, Artificial Sequence
  Description of Artificial Sequence: Synthetic peptide
  Seed: TYCLNVSLADTNSLAVVSTQLI (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQLI

SEQ ID NO: 339599 - protein, 22 aa, Artificial Sequence
  Description of Artificial Sequence: Synthetic peptide
  Seed: TYCLNVSLADTNSLAVVSTQLI (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQLI

SEQ ID NO: 339600 - protein, 22 aa, Artificial Sequence
  Description of Artificial Sequence: Synthetic peptide
  Seed: TYCLNVSLADTNSLAVVSTQLI (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTXLI

SEQ ID NO: 339601 - protein, 23 aa, Artificial Sequence
  Description of Artificial Sequence: Synthetic peptide
  Seed: TYCLNVSLADTNSLAVVSTQLIM (PMEL_HUMAN)
  Core: LNVSLADTN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
TYCXNVXLXDTXSLAVVSTQLIM

SEQ ID NO: 339602 - protein, 23 aa, Artificial Sequence
  Description of Artificial Sequence: Synthetic peptide
  Seed: TYCLNVSLADTNSLAVVSTQLIM (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQLIM

SEQ ID NO: 339603 - protein, 23 aa, Artificial Sequence
  Description of Artificial Sequence: Synthetic peptide
  Seed: TYCLNVSLADTNSLAVVSTQLIM (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQLIM

SEQ ID NO: 339604 - protein, 23 aa, Artificial Sequence
  Description of Artificial Sequence: Synthetic peptide
  Seed: TYCLNVSLADTNSLAVVSTQLIM (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTXLIM

SEQ ID NO: 339605 - protein, 24 aa, Artificial Sequence
  Description of Artificial Sequence: Synthetic peptide
  Seed: TYCLNVSLADTNSLAVVSTQLIMP (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQLIMP

SEQ ID NO: 339606 - protein, 24 aa, Artificial Sequence
  Description of Artificial Sequence: Synthetic peptide
  Seed: TYCLNVSLADTNSLAVVSTQLIMP (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQLIMP

SEQ ID NO: 339607 - protein, 24 aa, Artificial Sequence
  Description of Artificial Sequence: Synthetic peptide
  Seed: TYCLNVSLADTNSLAVVSTQLIMP (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTXLIMP

SEQ ID NO: 339608 - protein, 24 aa, Artificial Sequence
  Description of Artificial Sequence: Synthetic peptide
  Seed: TYCLNVSLADTNSLAVVSTQLIMP (PMEL_HUMAN)
  Core: LAVVSTQLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTNSXAVXSXQLXMP

SEQ ID NO: 339609 - protein, 25 aa, Artificial Sequence
  Description of Artificial Sequence: Synthetic peptide
  Seed: TYCLNVSLADTNSLAVVSTQLIMPG (PMEL_HUMAN)
  Core: LADTNSLAV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSXADXNXLAXVSTQLIMPG

SEQ ID NO: 339610 - protein, 25 aa, Artificial Sequence
  Description of Artificial Sequence: Synthetic peptide
  Seed: TYCLNVSLADTNSLAVVSTQLIMPG (PMEL_HUMAN)
  Core: DTNSLAVVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLAXTNXLXVVXTQLIMPG

SEQ ID NO: 339611 - protein, 25 aa, Artificial Sequence
  Description of Artificial Sequence: Synthetic peptide
  Seed: TYCLNVSLADTNSLAVVSTQLIMPG (PMEL_HUMAN)
  Core: NSLAVVSTQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTXSLXVXSTXLIMPG

SEQ ID NO: 339612 - protein, 25 aa, Artificial Sequence
  Description of Artificial Sequence: Synthetic peptide
  Seed: TYCLNVSLADTNSLAVVSTQLIMPG (PMEL_HUMAN)
  Core: LAVVSTQLI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYCLNVSLADTNSXAVXSXQLXMPG

SEQ ID NO: 339613 - protein, 13 aa, Artificial Sequence
  Description of Artificial Sequence: Synthetic peptide
  Seed: TYLEPGPVTAQVV (PMEL_HUMAN)
  Core: PGPVTAQVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYLEXGPXTXQVX

SEQ ID NO: 339614 - protein, 14 aa, Artificial Sequence
  Description of Artificial Sequence: Synthetic peptide
  Seed: TYLEPGPVTAQVVL (PMEL_HUMAN)
  Core: PGPVTAQVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYLEXGPXTXQVXL

SEQ ID NO: 339615 - protein, 15 aa, Artificial Sequence
  Description of Artificial Sequence: Synthetic peptide
  Seed: TYLEPGPVTAQVVLQ (PMEL_HUMAN)
  Core: LEPGPVTAQ
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
TYXEPXPXTAXVVLQ

SEQ ID NO: 339616 - protein, 15 aa, Artificial Sequence
  Description of Artificial Sequence: Synthetic peptide
  Seed: TYLEPGPVTAQVVLQ (PMEL_HUMAN)
  Core: PGPVTAQVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYLEXGPXTXQVXLQ

SEQ ID NO: 339617 - protein, 15 aa, Artificial Sequence
  Description of Artificial Sequence: Synthetic peptide
  Seed: TYLEPGPVTAQVVLQ (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLX

SEQ ID NO: 339618 - protein, 16 aa, Artificial Sequence
  Description of Artificial Sequence: Synthetic peptide
  Seed: TYLEPGPVTAQVVLQA (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXA

SEQ ID NO: 339619 - protein, 16 aa, Artificial Sequence
  Description of Artificial Sequence: Synthetic peptide
  Seed: TYLEPGPVTAQVVLQA (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQX

SEQ ID NO: 339620 - protein, 17 aa, Artificial Sequence
  Description of Artificial Sequence: Synthetic peptide
  Seed: TYLEPGPVTAQVVLQAA (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAA

SEQ ID NO: 339621 - protein, 17 aa, Artificial Sequence
  Description of Artificial Sequence: Synthetic peptide
  Seed: TYLEPGPVTAQVVLQAA (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXA

SEQ ID NO: 339622 - protein, 18 aa, Artificial Sequence
  Description of Artificial Sequence: Synthetic peptide
  Seed: TYLEPGPVTAQVVLQAAI (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAI

SEQ ID NO: 339623 - protein, 18 aa, Artificial Sequence
  Description of Artificial Sequence: Synthetic peptide
  Seed: TYLEPGPVTAQVVLQAAI (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAI

SEQ ID NO: 339624 - protein, 18 aa, Artificial Sequence
  Description of Artificial Sequence: Synthetic peptide
  Seed: TYLEPGPVTAQVVLQAAI (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXI

SEQ ID NO: 339625 - protein, 19 aa, Artificial Sequence
  Description of Artificial Sequence: Synthetic peptide
  Seed: TYLEPGPVTAQVVLQAAIP (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIP

SEQ ID NO: 339626 - protein, 19 aa, Artificial Sequence
  Description of Artificial Sequence: Synthetic peptide
  Seed: TYLEPGPVTAQVVLQAAIP (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIP

SEQ ID NO: 339627 - protein, 19 aa, Artificial Sequence
  Description of Artificial Sequence: Synthetic peptide
  Seed: TYLEPGPVTAQVVLQAAIP (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIP

SEQ ID NO: 339628 - protein, 20 aa, Artificial Sequence
  Description of Artificial Sequence: Synthetic peptide
  Seed: TYLEPGPVTAQVVLQAAIPL (PMEL_HUMAN)
  Core: PGPVTAQVV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
TYLEXGPXTXQVXLQAAIPL

SEQ ID NO: 339629 - protein, 20 aa, Artificial Sequence
  Description of Artificial Sequence: Synthetic peptide
  Seed: TYLEPGPVTAQVVLQAAIPL (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPL

SEQ ID NO: 339630 - protein, 20 aa, Artificial Sequence
  Description of Artificial Sequence: Synthetic peptide
  Seed: TYLEPGPVTAQVVLQAAIPL (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPL

SEQ ID NO: 339631 - protein, 20 aa, Artificial Sequence
  Description of Artificial Sequence: Synthetic peptide
  Seed: TYLEPGPVTAQVVLQAAIPL (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPL

SEQ ID NO: 339632 - protein, 21 aa, Artificial Sequence
  Description of Artificial Sequence: Synthetic peptide
  Seed: TYLEPGPVTAQVVLQAAIPLT (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPLT

SEQ ID NO: 339633 - protein, 21 aa, Artificial Sequence
  Description of Artificial Sequence: Synthetic peptide
  Seed: TYLEPGPVTAQVVLQAAIPLT (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPLT

SEQ ID NO: 339634 - protein, 21 aa, Artificial Sequence
  Description of Artificial Sequence: Synthetic peptide
  Seed: TYLEPGPVTAQVVLQAAIPLT (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPLT

SEQ ID NO: 339635 - protein, 21 aa, Artificial Sequence
  Description of Artificial Sequence: Synthetic peptide
  Seed: TYLEPGPVTAQVVLQAAIPLT (PMEL_HUMAN)
  Core: VVLQAAIPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQXVLXAXIPXT

SEQ ID NO: 339636 - protein, 22 aa, Artificial Sequence
  Description of Artificial Sequence: Synthetic peptide
  Seed: TYLEPGPVTAQVVLQAAIPLTS (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPLTS

SEQ ID NO: 339637 - protein, 22 aa, Artificial Sequence
  Description of Artificial Sequence: Synthetic peptide
  Seed: TYLEPGPVTAQVVLQAAIPLTS (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPLTS

SEQ ID NO: 339638 - protein, 22 aa, Artificial Sequence
  Description of Artificial Sequence: Synthetic peptide
  Seed: TYLEPGPVTAQVVLQAAIPLTS (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPLTS

SEQ ID NO: 339639 - protein, 22 aa, Artificial Sequence
  Description of Artificial Sequence: Synthetic peptide
  Seed: TYLEPGPVTAQVVLQAAIPLTS (PMEL_HUMAN)
  Core: VVLQAAIPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQXVLXAXIPXTS

SEQ ID NO: 339640 - protein, 23 aa, Artificial Sequence
  Description of Artificial Sequence: Synthetic peptide
  Seed: TYLEPGPVTAQVVLQAAIPLTSC (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPLTSC

SEQ ID NO: 339641 - protein, 23 aa, Artificial Sequence
  Description of Artificial Sequence: Synthetic peptide
  Seed: TYLEPGPVTAQVVLQAAIPLTSC (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPLTSC

SEQ ID NO: 339642 - protein, 23 aa, Artificial Sequence
  Description of Artificial Sequence: Synthetic peptide
  Seed: TYLEPGPVTAQVVLQAAIPLTSC (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPLTSC

SEQ ID NO: 339643 - protein, 23 aa, Artificial Sequence
  Description of Artificial Sequence: Synthetic peptide
  Seed: TYLEPGPVTAQVVLQAAIPLTSC (PMEL_HUMAN)
  Core: VVLQAAIPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQXVLXAXIPXTSC

SEQ ID NO: 339644 - protein, 24 aa, Artificial Sequence
  Description of Artificial Sequence: Synthetic peptide
  Seed: TYLEPGPVTAQVVLQAAIPLTSCG (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPLTSCG

SEQ ID NO: 339645 - protein, 24 aa, Artificial Sequence
  Description of Artificial Sequence: Synthetic peptide
  Seed: TYLEPGPVTAQVVLQAAIPLTSCG (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPLTSCG

SEQ ID NO: 339646 - protein, 24 aa, Artificial Sequence
  Description of Artificial Sequence: Synthetic peptide
  Seed: TYLEPGPVTAQVVLQAAIPLTSCG (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPLTSCG

SEQ ID NO: 339647 - protein, 24 aa, Artificial Sequence
  Description of Artificial Sequence: Synthetic peptide
  Seed: TYLEPGPVTAQVVLQAAIPLTSCG (PMEL_HUMAN)
  Core: VVLQAAIPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQXVLXAXIPXTSCG

SEQ ID NO: 339648 - protein, 24 aa, Artificial Sequence
  Description of Artificial Sequence: Synthetic peptide
  Seed: TYLEPGPVTAQVVLQAAIPLTSCG (PMEL_HUMAN)
  Core: LQAAIPLTS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQVVXQAXIXLTXCG

SEQ ID NO: 339649 - protein, 25 aa, Artificial Sequence
  Description of Artificial Sequence: Synthetic peptide
  Seed: TYLEPGPVTAQVVLQAAIPLTSCGS (PMEL_HUMAN)
  Core: PVTAQVVLQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGXVTXQXVLXAAIPLTSCGS

SEQ ID NO: 339650 - protein, 25 aa, Artificial Sequence
  Description of Artificial Sequence: Synthetic peptide
  Seed: TYLEPGPVTAQVVLQAAIPLTSCGS (PMEL_HUMAN)
  Core: VTAQVVLQA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPXTAXVXLQXAIPLTSCGS

SEQ ID NO: 339651 - protein, 25 aa, Artificial Sequence
  Description of Artificial Sequence: Synthetic peptide
  Seed: TYLEPGPVTAQVVLQAAIPLTSCGS (PMEL_HUMAN)
  Core: TAQVVLQAA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVXAQXVXQAXIPLTSCGS

SEQ ID NO: 339652 - protein, 25 aa, Artificial Sequence
  Description of Artificial Sequence: Synthetic peptide
  Seed: TYLEPGPVTAQVVLQAAIPLTSCGS (PMEL_HUMAN)
  Core: VVLQAAIPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQXVLXAXIPXTSCGS

SEQ ID NO: 339653 - protein, 25 aa, Artificial Sequence
  Description of Artificial Sequence: Synthetic peptide
  Seed: TYLEPGPVTAQVVLQAAIPLTSCGS (PMEL_HUMAN)
  Core: LQAAIPLTS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
TYLEPGPVTAQVVXQAXIXLTXCGS

SEQ ID NO: 339654 - protein, 25 aa, Artificial Sequence
  Description of Artificial Sequence: Synthetic peptide
  Seed: VETTARELPIPEPEGPDASSIMSTE (PMEL_HUMAN)
  Core: PDASSIMST
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VETTARELPIPEPEGXDAXSXMSXE

SEQ ID NO: 339655 - protein, 21 aa, Artificial Sequence
  Description of Artificial Sequence: Synthetic peptide
  Seed: VGATKVPRNQDWLGVSRQLRT (PMEL_HUMAN)
  Core: WLGVSRQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPRNQDXLGXSXQLXT

SEQ ID NO: 339656 - protein, 22 aa, Artificial Sequence
  Description of Artificial Sequence: Synthetic peptide
  Seed: VGATKVPRNQDWLGVSRQLRTK (PMEL_HUMAN)
  Core: WLGVSRQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPRNQDXLGXSXQLXTK

SEQ ID NO: 339657 - protein, 23 aa, Artificial Sequence
  Description of Artificial Sequence: Synthetic peptide
  Seed: VGATKVPRNQDWLGVSRQLRTKA (PMEL_HUMAN)
  Core: WLGVSRQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPRNQDXLGXSXQLXTKA

SEQ ID NO: 339658 - protein, 24 aa, Artificial Sequence
  Description of Artificial Sequence: Synthetic peptide
  Seed: VGATKVPRNQDWLGVSRQLRTKAW (PMEL_HUMAN)
  Core: RNQDWLGVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPXNQXWXGVXRQLRTKAW

SEQ ID NO: 339659 - protein, 24 aa, Artificial Sequence
  Description of Artificial Sequence: Synthetic peptide
  Seed: VGATKVPRNQDWLGVSRQLRTKAW (PMEL_HUMAN)
  Core: WLGVSRQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPRNQDXLGXSXQLXTKAW

SEQ ID NO: 339660 - protein, 25 aa, Artificial Sequence
  Description of Artificial Sequence: Synthetic peptide
  Seed: VGATKVPRNQDWLGVSRQLRTKAWN (PMEL_HUMAN)
  Core: RNQDWLGVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPXNQXWXGVXRQLRTKAWN

SEQ ID NO: 339661 - protein, 25 aa, Artificial Sequence
  Description of Artificial Sequence: Synthetic peptide
  Seed: VGATKVPRNQDWLGVSRQLRTKAWN (PMEL_HUMAN)
  Core: WLGVSRQLR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGATKVPRNQDXLGXSXQLXTKAWN

SEQ ID NO: 339662 - protein, 14 aa, Artificial Sequence
  Description of Artificial Sequence: Synthetic peptide
  Seed: VGILLVLMAVVLAS (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXAS

SEQ ID NO: 339663 - protein, 15 aa, Artificial Sequence
  Description of Artificial Sequence: Synthetic peptide
  Seed: VGILLVLMAVVLASL (PMEL_HUMAN)
  Core: ILLVLMAVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXLLXLXAVXLASL

SEQ ID NO: 339664 - protein, 15 aa, Artificial Sequence
  Description of Artificial Sequence: Synthetic peptide
  Seed: VGILLVLMAVVLASL (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASL

SEQ ID NO: 339665 - protein, 15 aa, Artificial Sequence
  Description of Artificial Sequence: Synthetic peptide
  Seed: VGILLVLMAVVLASL (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSL

SEQ ID NO: 339666 - protein, 15 aa, Artificial Sequence
  Description of Artificial Sequence: Synthetic peptide
  Seed: VGILLVLMAVVLASL (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASX

SEQ ID NO: 339667 - protein, 16 aa, Artificial Sequence
  Description of Artificial Sequence: Synthetic peptide
  Seed: VGILLVLMAVVLASLI (PMEL_HUMAN)
  Core: ILLVLMAVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXLLXLXAVXLASLI

SEQ ID NO: 339668 - protein, 16 aa, Artificial Sequence
  Description of Artificial Sequence: Synthetic peptide
  Seed: VGILLVLMAVVLASLI (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLI

SEQ ID NO: 339669 - protein, 16 aa, Artificial Sequence
  Description of Artificial Sequence: Synthetic peptide
  Seed: VGILLVLMAVVLASLI (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLI

SEQ ID NO: 339670 - protein, 16 aa, Artificial Sequence
  Description of Artificial Sequence: Synthetic peptide
  Seed: VGILLVLMAVVLASLI (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLI

SEQ ID NO: 339671 - protein, 16 aa, Artificial Sequence
  Description of Artificial Sequence: Synthetic peptide
  Seed: VGILLVLMAVVLASLI (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASXI

SEQ ID NO: 339672 - protein, 16 aa, Artificial Sequence
  Description of Artificial Sequence: Synthetic peptide
  Seed: VGILLVLMAVVLASLI (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLX

SEQ ID NO: 339673 - protein, 17 aa, Artificial Sequence
  Description of Artificial Sequence: Synthetic peptide
  Seed: VGILLVLMAVVLASLIY (PMEL_HUMAN)
  Core: ILLVLMAVV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXLLXLXAVXLASLIY

SEQ ID NO: 339674 - protein, 17 aa, Artificial Sequence
  Description of Artificial Sequence: Synthetic peptide
  Seed: VGILLVLMAVVLASLIY (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIY

SEQ ID NO: 339675 - protein, 17 aa, Artificial Sequence
  Description of Artificial Sequence: Synthetic peptide
  Seed: VGILLVLMAVVLASLIY (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIY

SEQ ID NO: 339676 - protein, 17 aa, Artificial Sequence
  Description of Artificial Sequence: Synthetic peptide
  Seed: VGILLVLMAVVLASLIY (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIY

SEQ ID NO: 339677 - protein, 17 aa, Artificial Sequence
  Description of Artificial Sequence: Synthetic peptide
  Seed: VGILLVLMAVVLASLIY (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASXIY

SEQ ID NO: 339678 - protein, 17 aa, Artificial Sequence
  Description of Artificial Sequence: Synthetic peptide
  Seed: VGILLVLMAVVLASLIY (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXY

SEQ ID NO: 339679 - protein, 18 aa, Artificial Sequence
  Description of Artificial Sequence: Synthetic peptide
  Seed: VGILLVLMAVVLASLIYR (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYR

SEQ ID NO: 339680 - protein, 18 aa, Artificial Sequence
  Description of Artificial Sequence: Synthetic peptide
  Seed: VGILLVLMAVVLASLIYR (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYR

SEQ ID NO: 339681 - protein, 18 aa, Artificial Sequence
  Description of Artificial Sequence: Synthetic peptide
  Seed: VGILLVLMAVVLASLIYR (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASXIYR

SEQ ID NO: 339682 - protein, 19 aa, Artificial Sequence
  Description of Artificial Sequence: Synthetic peptide
  Seed: VGILLVLMAVVLASLIYRR (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRR

SEQ ID NO: 339683 - protein, 19 aa, Artificial Sequence
  Description of Artificial Sequence: Synthetic peptide
  Seed: VGILLVLMAVVLASLIYRR (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRR

SEQ ID NO: 339684 - protein, 19 aa, Artificial Sequence
  Description of Artificial Sequence: Synthetic peptide
  Seed: VGILLVLMAVVLASLIYRR (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRR

SEQ ID NO: 339685 - protein, 19 aa, Artificial Sequence
  Description of Artificial Sequence: Synthetic peptide
  Seed: VGILLVLMAVVLASLIYRR (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASXIYRR

SEQ ID NO: 339686 - protein, 19 aa, Artificial Sequence
  Description of Artificial Sequence: Synthetic peptide
  Seed: VGILLVLMAVVLASLIYRR (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRR

SEQ ID NO: 339687 - protein, 19 aa, Artificial Sequence
  Description of Artificial Sequence: Synthetic peptide
  Seed: VGILLVLMAVVLASLIYRR (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRR

SEQ ID NO: 339688 - protein, 19 aa, Artificial Sequence
  Description of Artificial Sequence: Synthetic peptide
  Seed: VGILLVLMAVVLASLIYRR (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXR

SEQ ID NO: 339689 - protein, 19 aa, Artificial Sequence
  Description of Artificial Sequence: Synthetic peptide
  Seed: VGILLVLMAVVLASLIYRR (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRX

SEQ ID NO: 339690 - protein, 20 aa, Artificial Sequence
  Description of Artificial Sequence: Synthetic peptide
  Seed: VGILLVLMAVVLASLIYRRR (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRR

SEQ ID NO: 339691 - protein, 20 aa, Artificial Sequence
  Description of Artificial Sequence: Synthetic peptide
  Seed: VGILLVLMAVVLASLIYRRR (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRR

SEQ ID NO: 339692 - protein, 20 aa, Artificial Sequence
  Description of Artificial Sequence: Synthetic peptide
  Seed: VGILLVLMAVVLASLIYRRR (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRR

SEQ ID NO: 339693 - protein, 20 aa, Artificial Sequence
  Description of Artificial Sequence: Synthetic peptide
  Seed: VGILLVLMAVVLASLIYRRR (PMEL_HUMAN)
  Core: LMAVVLASL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVXMAXVXASXIYRRR

SEQ ID NO: 339694 - protein, 20 aa, Artificial Sequence
  Description of Artificial Sequence: Synthetic peptide
  Seed: VGILLVLMAVVLASLIYRRR (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRRR

SEQ ID NO: 339695 - protein, 20 aa, Artificial Sequence
  Description of Artificial Sequence: Synthetic peptide
  Seed: VGILLVLMAVVLASLIYRRR (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRRR

SEQ ID NO: 339696 - protein, 20 aa, Artificial Sequence
  Description of Artificial Sequence: Synthetic peptide
  Seed: VGILLVLMAVVLASLIYRRR (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXRR

SEQ ID NO: 339697 - protein, 20 aa, Artificial Sequence
  Description of Artificial Sequence: Synthetic peptide
  Seed: VGILLVLMAVVLASLIYRRR (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXR

SEQ ID NO: 339698 - protein, 20 aa, Artificial Sequence
  Description of Artificial Sequence: Synthetic peptide
  Seed: VGILLVLMAVVLASLIYRRR (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRX

SEQ ID NO: 339699 - protein, 21 aa, Artificial Sequence
  Description of Artificial Sequence: Synthetic peptide
  Seed: VGILLVLMAVVLASLIYRRRL (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRRL

SEQ ID NO: 339700 - protein, 21 aa, Artificial Sequence
  Description of Artificial Sequence: Synthetic peptide
  Seed: VGILLVLMAVVLASLIYRRRL (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRRL

SEQ ID NO: 339701 - protein, 21 aa, Artificial Sequence
  Description of Artificial Sequence: Synthetic peptide
  Seed: VGILLVLMAVVLASLIYRRRL (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRRL

SEQ ID NO: 339702 - protein, 21 aa, Artificial Sequence
  Description of Artificial Sequence: Synthetic peptide
  Seed: VGILLVLMAVVLASLIYRRRL (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXRRL

SEQ ID NO: 339703 - protein, 21 aa, Artificial Sequence
  Description of Artificial Sequence: Synthetic peptide
  Seed: VGILLVLMAVVLASLIYRRRL (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXRL

SEQ ID NO: 339704 - protein, 21 aa, Artificial Sequence
  Description of Artificial Sequence: Synthetic peptide
  Seed: VGILLVLMAVVLASLIYRRRL (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRXL

SEQ ID NO: 339705 - protein, 22 aa, Artificial Sequence
  Description of Artificial Sequence: Synthetic peptide
  Seed: VGILLVLMAVVLASLIYRRRLM (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRRLM

SEQ ID NO: 339706 - protein, 22 aa, Artificial Sequence
  Description of Artificial Sequence: Synthetic peptide
  Seed: VGILLVLMAVVLASLIYRRRLM (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRRLM

SEQ ID NO: 339707 - protein, 22 aa, Artificial Sequence
  Description of Artificial Sequence: Synthetic peptide
  Seed: VGILLVLMAVVLASLIYRRRLM (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRRLM

SEQ ID NO: 339708 - protein, 22 aa, Artificial Sequence
  Description of Artificial Sequence: Synthetic peptide
  Seed: VGILLVLMAVVLASLIYRRRLM (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRRRLM

SEQ ID NO: 339709 - protein, 22 aa, Artificial Sequence
  Description of Artificial Sequence: Synthetic peptide
  Seed: VGILLVLMAVVLASLIYRRRLM (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRRRLM

SEQ ID NO: 339710 - protein, 22 aa, Artificial Sequence
  Description of Artificial Sequence: Synthetic peptide
  Seed: VGILLVLMAVVLASLIYRRRLM (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXRRLM

SEQ ID NO: 339711 - protein, 22 aa, Artificial Sequence
  Description of Artificial Sequence: Synthetic peptide
  Seed: VGILLVLMAVVLASLIYRRRLM (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXRLM

SEQ ID NO: 339712 - protein, 22 aa, Artificial Sequence
  Description of Artificial Sequence: Synthetic peptide
  Seed: VGILLVLMAVVLASLIYRRRLM (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRXLM

SEQ ID NO: 339713 - protein, 23 aa, Artificial Sequence
  Description of Artificial Sequence: Synthetic peptide
  Seed: VGILLVLMAVVLASLIYRRRLMK (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRRLMK

SEQ ID NO: 339714 - protein, 23 aa, Artificial Sequence
  Description of Artificial Sequence: Synthetic peptide
  Seed: VGILLVLMAVVLASLIYRRRLMK (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRRLMK

SEQ ID NO: 339715 - protein, 23 aa, Artificial Sequence
  Description of Artificial Sequence: Synthetic peptide
  Seed: VGILLVLMAVVLASLIYRRRLMK (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRRLMK

SEQ ID NO: 339716 - protein, 23 aa, Artificial Sequence
  Description of Artificial Sequence: Synthetic peptide
  Seed: VGILLVLMAVVLASLIYRRRLMK (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRRRLMK

SEQ ID NO: 339717 - protein, 23 aa, Artificial Sequence
  Description of Artificial Sequence: Synthetic peptide
  Seed: VGILLVLMAVVLASLIYRRRLMK (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRRRLMK

SEQ ID NO: 339718 - protein, 23 aa, Artificial Sequence
  Description of Artificial Sequence: Synthetic peptide
  Seed: VGILLVLMAVVLASLIYRRRLMK (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXRRLMK

SEQ ID NO: 339719 - protein, 23 aa, Artificial Sequence
  Description of Artificial Sequence: Synthetic peptide
  Seed: VGILLVLMAVVLASLIYRRRLMK (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXRLMK

SEQ ID NO: 339720 - protein, 23 aa, Artificial Sequence
  Description of Artificial Sequence: Synthetic peptide
  Seed: VGILLVLMAVVLASLIYRRRLMK (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRXLMK

SEQ ID NO: 339721 - protein, 23 aa, Artificial Sequence
  Description of Artificial Sequence: Synthetic peptide
  Seed: VGILLVLMAVVLASLIYRRRLMK (PMEL_HUMAN)
  Core: SLIYRRRLM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLAXLIXRXRLXK

SEQ ID NO: 339722 - protein, 24 aa, Artificial Sequence
  Description of Artificial Sequence: Synthetic peptide
  Seed: VGILLVLMAVVLASLIYRRRLMKQ (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRRLMKQ

SEQ ID NO: 339723 - protein, 24 aa, Artificial Sequence
  Description of Artificial Sequence: Synthetic peptide
  Seed: VGILLVLMAVVLASLIYRRRLMKQ (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRRLMKQ

SEQ ID NO: 339724 - protein, 24 aa, Artificial Sequence
  Description of Artificial Sequence: Synthetic peptide
  Seed: VGILLVLMAVVLASLIYRRRLMKQ (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRRLMKQ

SEQ ID NO: 339725 - protein, 24 aa, Artificial Sequence
  Description of Artificial Sequence: Synthetic peptide
  Seed: VGILLVLMAVVLASLIYRRRLMKQ (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRRRLMKQ

SEQ ID NO: 339726 - protein, 24 aa, Artificial Sequence
  Description of Artificial Sequence: Synthetic peptide
  Seed: VGILLVLMAVVLASLIYRRRLMKQ (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRRRLMKQ

SEQ ID NO: 339727 - protein, 24 aa, Artificial Sequence
  Description of Artificial Sequence: Synthetic peptide
  Seed: VGILLVLMAVVLASLIYRRRLMKQ (PMEL_HUMAN)
  Core: VVLASLIYR
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAXVLXSXIYXRRLMKQ

SEQ ID NO: 339728 - protein, 24 aa, Artificial Sequence
  Description of Artificial Sequence: Synthetic peptide
  Seed: VGILLVLMAVVLASLIYRRRLMKQ (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXRLMKQ

SEQ ID NO: 339729 - protein, 24 aa, Artificial Sequence
  Description of Artificial Sequence: Synthetic peptide
  Seed: VGILLVLMAVVLASLIYRRRLMKQ (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRXLMKQ

SEQ ID NO: 339730 - protein, 24 aa, Artificial Sequence
  Description of Artificial Sequence: Synthetic peptide
  Seed: VGILLVLMAVVLASLIYRRRLMKQ (PMEL_HUMAN)
  Core: ASLIYRRRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLXSLXYXRRXMKQ

SEQ ID NO: 339731 - protein, 24 aa, Artificial Sequence
  Description of Artificial Sequence: Synthetic peptide
  Seed: VGILLVLMAVVLASLIYRRRLMKQ (PMEL_HUMAN)
  Core: SLIYRRRLM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLAXLIXRXRLXKQ

SEQ ID NO: 339732 - protein, 24 aa, Artificial Sequence
  Description of Artificial Sequence: Synthetic peptide
  Seed: VGILLVLMAVVLASLIYRRRLMKQ (PMEL_HUMAN)
  Core: LIYRRRLMK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLASXIYXRXLMXQ

SEQ ID NO: 339733 - protein, 25 aa, Artificial Sequence
  Description of Artificial Sequence: Synthetic peptide
  Seed: VGILLVLMAVVLASLIYRRRLMKQD (PMEL_HUMAN)
  Core: LLVLMAVVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VGIXLVXMXVVXASLIYRRRLMKQD

SEQ ID NO: 339734 - protein, 25 aa, Artificial Sequence
  Description of Artificial Sequence: Synthetic peptide
  Seed: VGILLVLMAVVLASLIYRRRLMKQD (PMEL_HUMAN)
  Core: LVLMAVVLA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VGILXVLXAXVLXSLIYRRRLMKQD

SEQ ID NO: 339735 - protein, 25 aa, Artificial Sequence
  Description of Artificial Sequence: Synthetic peptide
  Seed: VGILLVLMAVVLASLIYRRRLMKQD (PMEL_HUMAN)
  Core: VLMAVVLAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VGILLXLMXVXLAXLIYRRRLMKQD

SEQ ID NO: 339736 - protein, 25 aa, Artificial Sequence
  Description of Artificial Sequence: Synthetic peptide
  Seed: VGILLVLMAVVLASLIYRRRLMKQD (PMEL_HUMAN)
  Core: MAVVLASLI
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLXAVXLXSLXYRRRLMKQD

SEQ ID NO: 339737 - protein, 25 aa, Artificial Sequence
  Description of Artificial Sequence: Synthetic peptide
  Seed: VGILLVLMAVVLASLIYRRRLMKQD (PMEL_HUMAN)
  Core: AVVLASLIY
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMXVVXAXLIXRRRLMKQD

SEQ ID NO: 339738 - protein, 25 aa, Artificial Sequence
  Description of Artificial Sequence: Synthetic peptide
  Seed: VGILLVLMAVVLASLIYRRRLMKQD (PMEL_HUMAN)
  Core: VLASLIYRR
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVXLAXLXYRXRLMKQD

SEQ ID NO: 339739 - protein, 25 aa, Artificial Sequence
  Description of Artificial Sequence: Synthetic peptide
  Seed: VGILLVLMAVVLASLIYRRRLMKQD (PMEL_HUMAN)
  Core: LASLIYRRR
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVXASXIXRRXLMKQD

SEQ ID NO: 339740 - protein, 25 aa, Artificial Sequence
  Description of Artificial Sequence: Synthetic peptide
  Seed: VGILLVLMAVVLASLIYRRRLMKQD (PMEL_HUMAN)
  Core: ASLIYRRRL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLXSLXYXRRXMKQD

SEQ ID NO: 339741 - protein, 25 aa, Artificial Sequence
  Description of Artificial Sequence: Synthetic peptide
  Seed: VGILLVLMAVVLASLIYRRRLMKQD (PMEL_HUMAN)
  Core: SLIYRRRLM
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLAXLIXRXRLXKQD

SEQ ID NO: 339742 - protein, 25 aa, Artificial Sequence
  Description of Artificial Sequence: Synthetic peptide
  Seed: VGILLVLMAVVLASLIYRRRLMKQD (PMEL_HUMAN)
  Core: LIYRRRLMK
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VGILLVLMAVVLASXIYXRXLMXQD

SEQ ID NO: 339743 - protein, 14 aa, Artificial Sequence
  Description of Artificial Sequence: Synthetic peptide
  Seed: VGTTPGQAPTAEPS (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPS

SEQ ID NO: 339744 - protein, 15 aa, Artificial Sequence
  Description of Artificial Sequence: Synthetic peptide
  Seed: VGTTPGQAPTAEPSG (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSG

SEQ ID NO: 339745 - protein, 16 aa, Artificial Sequence
  Description of Artificial Sequence: Synthetic peptide
  Seed: VGTTPGQAPTAEPSGT (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGT

SEQ ID NO: 339746 - protein, 17 aa, Artificial Sequence
  Description of Artificial Sequence: Synthetic peptide
  Seed: VGTTPGQAPTAEPSGTT (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGTT

SEQ ID NO: 339747 - protein, 19 aa, Artificial Sequence
  Description of Artificial Sequence: Synthetic peptide
  Seed: VGTTPGQAPTAEPSGTTSV (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGTTSV

SEQ ID NO: 339748 - protein, 20 aa, Artificial Sequence
  Description of Artificial Sequence: Synthetic peptide
  Seed: VGTTPGQAPTAEPSGTTSVQ (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGTTSVQ

SEQ ID NO: 339749 - protein, 21 aa, Artificial Sequence
  Description of Artificial Sequence: Synthetic peptide
  Seed: VGTTPGQAPTAEPSGTTSVQV (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGTTSVQV

SEQ ID NO: 339750 - protein, 22 aa, Artificial Sequence
  Description of Artificial Sequence: Synthetic peptide
  Seed: VGTTPGQAPTAEPSGTTSVQVP (PMEL_HUMAN)
  Core: TTPGQAPTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VGXTPXQXPTXEPSGTTSVQVP

SEQ ID NO: 339751 - protein, 23 aa, Artificial Sequence
  Description of Artificial Sequence: Synthetic peptide
  Seed: VGTTPGQAPTAEPSGTTSVQVPT (PMEL_HUMAN)
  Core: PSGTTSVQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VGTTPGQAPTAEXSGXTXVQXPT

SEQ ID NO: 339752 - protein, 24 aa, Artificial Sequence
  Description of Artificial Sequence: Synthetic peptide
  Seed: VGTTPGQAPTAEPSGTTSVQVPTT (PMEL_HUMAN)
  Core: PSGTTSVQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VGTTPGQAPTAEXSGXTXVQXPTT

SEQ ID NO: 339753 - protein, 25 aa, Artificial Sequence
  Description of Artificial Sequence: Synthetic peptide
  Seed: VGTTPGQAPTAEPSGTTSVQVPTTE (PMEL_HUMAN)
  Core: PSGTTSVQV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VGTTPGQAPTAEXSGXTXVQXPTTE

SEQ ID NO: 339754 - protein, 13 aa, Artificial Sequence
  Description of Artificial Sequence: Synthetic peptide
  Seed: VIGALLAVGATKV (PMEL_HUMAN)
  Core: IGALLAVGA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXGAXLXVGXTKV

SEQ ID NO: 339755 - protein, 13 aa, Artificial Sequence
  Description of Artificial Sequence: Synthetic peptide
  Seed: VIGALLAVGATKV (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKX

SEQ ID NO: 339756 - protein, 14 aa, Artificial Sequence
  Description of Artificial Sequence: Synthetic peptide
  Seed: VIGALLAVGATKVP (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXP

SEQ ID NO: 339757 - protein, 15 aa, Artificial Sequence
  Description of Artificial Sequence: Synthetic peptide
  Seed: VIGALLAVGATKVPR (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPR

SEQ ID NO: 339758 - protein, 16 aa, Artificial Sequence
  Description of Artificial Sequence: Synthetic peptide
  Seed: VIGALLAVGATKVPRN (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRN

SEQ ID NO: 339759 - protein, 17 aa, Artificial Sequence
  Description of Artificial Sequence: Synthetic peptide
  Seed: VIGALLAVGATKVPRNQ (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQ

SEQ ID NO: 339760 - protein, 17 aa, Artificial Sequence
  Description of Artificial Sequence: Synthetic peptide
  Seed: VIGALLAVGATKVPRNQ (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQ

SEQ ID NO: 339761 - protein, 18 aa, Artificial Sequence
  Description of Artificial Sequence: Synthetic peptide
  Seed: VIGALLAVGATKVPRNQD (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQD

SEQ ID NO: 339762 - protein, 18 aa, Artificial Sequence
  Description of Artificial Sequence: Synthetic peptide
  Seed: VIGALLAVGATKVPRNQD (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQD

SEQ ID NO: 339763 - protein, 19 aa, Artificial Sequence
  Description of Artificial Sequence: Synthetic peptide
  Seed: VIGALLAVGATKVPRNQDW (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDW

SEQ ID NO: 339764 - protein, 19 aa, Artificial Sequence
  Description of Artificial Sequence: Synthetic peptide
  Seed: VIGALLAVGATKVPRNQDW (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDW

SEQ ID NO: 339765 - protein, 19 aa, Artificial Sequence
  Description of Artificial Sequence: Synthetic peptide
  Seed: VIGALLAVGATKVPRNQDW (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDW

SEQ ID NO: 339766 - protein, 20 aa, Artificial Sequence
  Description of Artificial Sequence: Synthetic peptide
  Seed: VIGALLAVGATKVPRNQDWL (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWL

SEQ ID NO: 339767 - protein, 20 aa, Artificial Sequence
  Description of Artificial Sequence: Synthetic peptide
  Seed: VIGALLAVGATKVPRNQDWL (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWL

SEQ ID NO: 339768 - protein, 20 aa, Artificial Sequence
  Description of Artificial Sequence: Synthetic peptide
  Seed: VIGALLAVGATKVPRNQDWL (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWL

SEQ ID NO: 339769 - protein, 21 aa, Artificial Sequence
  Description of Artificial Sequence: Synthetic peptide
  Seed: VIGALLAVGATKVPRNQDWLG (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWLG

SEQ ID NO: 339770 - protein, 21 aa, Artificial Sequence
  Description of Artificial Sequence: Synthetic peptide
  Seed: VIGALLAVGATKVPRNQDWLG (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWLG

SEQ ID NO: 339771 - protein, 21 aa, Artificial Sequence
  Description of Artificial Sequence: Synthetic peptide
  Seed: VIGALLAVGATKVPRNQDWLG (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWLG

SEQ ID NO: 339772 - protein, 22 aa, Artificial Sequence
  Description of Artificial Sequence: Synthetic peptide
  Seed: VIGALLAVGATKVPRNQDWLGV (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWLGV

SEQ ID NO: 339773 - protein, 22 aa, Artificial Sequence
  Description of Artificial Sequence: Synthetic peptide
  Seed: VIGALLAVGATKVPRNQDWLGV (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWLGV

SEQ ID NO: 339774 - protein, 22 aa, Artificial Sequence
  Description of Artificial Sequence: Synthetic peptide
  Seed: VIGALLAVGATKVPRNQDWLGV (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWLGV

SEQ ID NO: 339775 - protein, 23 aa, Artificial Sequence
  Description of Artificial Sequence: Synthetic peptide
  Seed: VIGALLAVGATKVPRNQDWLGVS (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWLGVS

SEQ ID NO: 339776 - protein, 23 aa, Artificial Sequence
  Description of Artificial Sequence: Synthetic peptide
  Seed: VIGALLAVGATKVPRNQDWLGVS (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWLGVS

SEQ ID NO: 339777 - protein, 23 aa, Artificial Sequence
  Description of Artificial Sequence: Synthetic peptide
  Seed: VIGALLAVGATKVPRNQDWLGVS (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWLGVS

SEQ ID NO: 339778 - protein, 24 aa, Artificial Sequence
  Description of Artificial Sequence: Synthetic peptide
  Seed: VIGALLAVGATKVPRNQDWLGVSR (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWLGVSR

SEQ ID NO: 339779 - protein, 24 aa, Artificial Sequence
  Description of Artificial Sequence: Synthetic peptide
  Seed: VIGALLAVGATKVPRNQDWLGVSR (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWLGVSR

SEQ ID NO: 339780 - protein, 24 aa, Artificial Sequence
  Description of Artificial Sequence: Synthetic peptide
  Seed: VIGALLAVGATKVPRNQDWLGVSR (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWLGVSR

SEQ ID NO: 339781 - protein, 24 aa, Artificial Sequence
  Description of Artificial Sequence: Synthetic peptide
  Seed: VIGALLAVGATKVPRNQDWLGVSR (PMEL_HUMAN)
  Core: RNQDWLGVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAVGATKVPXNQXWXGVXR

SEQ ID NO: 339782 - protein, 25 aa, Artificial Sequence
  Description of Artificial Sequence: Synthetic peptide
  Seed: VIGALLAVGATKVPRNQDWLGVSRQ (PMEL_HUMAN)
  Core: LLAVGATKV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VIGAXLAXGXTKXPRNQDWLGVSRQ

SEQ ID NO: 339783 - protein, 25 aa, Artificial Sequence
  Description of Artificial Sequence: Synthetic peptide
  Seed: VIGALLAVGATKVPRNQDWLGVSRQ (PMEL_HUMAN)
  Core: AVGATKVPR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLXVGXTXVPXNQDWLGVSRQ

SEQ ID NO: 339784 - protein, 25 aa, Artificial Sequence
  Description of Artificial Sequence: Synthetic peptide
  Seed: VIGALLAVGATKVPRNQDWLGVSRQ (PMEL_HUMAN)
  Core: VGATKVPRN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAXGAXKXPRXQDWLGVSRQ

SEQ ID NO: 339785 - protein, 25 aa, Artificial Sequence
  Description of Artificial Sequence: Synthetic peptide
  Seed: VIGALLAVGATKVPRNQDWLGVSRQ (PMEL_HUMAN)
  Core: RNQDWLGVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VIGALLAVGATKVPXNQXWXGVXRQ

SEQ ID NO: 339786 - protein, 13 aa, Artificial Sequence
  Description of Artificial Sequence: Synthetic peptide
  Seed: VISTAPVQMPTAE (PMEL_HUMAN)
  Core: ISTAPVQMP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSTXPXQMXTAE

SEQ ID NO: 339787 - protein, 14 aa, Artificial Sequence
  Description of Artificial Sequence: Synthetic peptide
  Seed: VISTAPVQMPTAES (PMEL_HUMAN)
  Core: ISTAPVQMP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSTXPXQMXTAES

SEQ ID NO: 339788 - protein, 14 aa, Artificial Sequence
  Description of Artificial Sequence: Synthetic peptide
  Seed: VISTAPVQMPTAES (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXES

SEQ ID NO: 339789 - protein, 15 aa, Artificial Sequence
  Description of Artificial Sequence: Synthetic peptide
  Seed: VISTAPVQMPTAEST (PMEL_HUMAN)
  Core: ISTAPVQMP
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSTXPXQMXTAEST

SEQ ID NO: 339790 - protein, 15 aa, Artificial Sequence
  Description of Artificial Sequence: Synthetic peptide
  Seed: VISTAPVQMPTAEST (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXEST

SEQ ID NO: 339791 - protein, 15 aa, Artificial Sequence
  Description of Artificial Sequence: Synthetic peptide
  Seed: VISTAPVQMPTAEST (PMEL_HUMAN)
  Core: PVQMPTAES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VISTAXVQXPXAEXT

SEQ ID NO: 339792 - protein, 15 aa, Artificial Sequence
  Description of Artificial Sequence: Synthetic peptide
  Seed: VISTAPVQMPTAEST (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESX

SEQ ID NO: 339793 - protein, 16 aa, Artificial Sequence
  Description of Artificial Sequence: Synthetic peptide
  Seed: VISTAPVQMPTAESTG (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTG

SEQ ID NO: 339794 - protein, 16 aa, Artificial Sequence
  Description of Artificial Sequence: Synthetic peptide
  Seed: VISTAPVQMPTAESTG (PMEL_HUMAN)
  Core: PVQMPTAES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VISTAXVQXPXAEXTG

SEQ ID NO: 339795 - protein, 16 aa, Artificial Sequence
  Description of Artificial Sequence: Synthetic peptide
  Seed: VISTAPVQMPTAESTG (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXG

SEQ ID NO: 339796 - protein, 17 aa, Artificial Sequence
  Description of Artificial Sequence: Synthetic peptide
  Seed: VISTAPVQMPTAESTGM (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTGM

SEQ ID NO: 339797 - protein, 17 aa, Artificial Sequence
  Description of Artificial Sequence: Synthetic peptide
  Seed: VISTAPVQMPTAESTGM (PMEL_HUMAN)
  Core: PVQMPTAES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VISTAXVQXPXAEXTGM

SEQ ID NO: 339798 - protein, 17 aa, Artificial Sequence
  Description of Artificial Sequence: Synthetic peptide
  Seed: VISTAPVQMPTAESTGM (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGM

SEQ ID NO: 339799 - protein, 18 aa, Artificial Sequence
  Description of Artificial Sequence: Synthetic peptide
  Seed: VISTAPVQMPTAESTGMT (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMT

SEQ ID NO: 339800 - protein, 19 aa, Artificial Sequence
  Description of Artificial Sequence: Synthetic peptide
  Seed: VISTAPVQMPTAESTGMTP (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTGMTP

SEQ ID NO: 339801 - protein, 19 aa, Artificial Sequence
  Description of Artificial Sequence: Synthetic peptide
  Seed: VISTAPVQMPTAESTGMTP (PMEL_HUMAN)
  Core: PVQMPTAES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VISTAXVQXPXAEXTGMTP

SEQ ID NO: 339802 - protein, 19 aa, Artificial Sequence
  Description of Artificial Sequence: Synthetic peptide
  Seed: VISTAPVQMPTAESTGMTP (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTP

SEQ ID NO: 339803 - protein, 20 aa, Artificial Sequence
  Description of Artificial Sequence: Synthetic peptide
  Seed: VISTAPVQMPTAESTGMTPE (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTGMTPE

SEQ ID NO: 339804 - protein, 20 aa, Artificial Sequence
  Description of Artificial Sequence: Synthetic peptide
  Seed: VISTAPVQMPTAESTGMTPE (PMEL_HUMAN)
  Core: PVQMPTAES
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VISTAXVQXPXAEXTGMTPE

SEQ ID NO: 339805 - protein, 20 aa, Artificial Sequence
  Description of Artificial Sequence: Synthetic peptide
  Seed: VISTAPVQMPTAESTGMTPE (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTPE

SEQ ID NO: 339806 - protein, 20 aa, Artificial Sequence
  Description of Artificial Sequence: Synthetic peptide
  Seed: VISTAPVQMPTAESTGMTPE (PMEL_HUMAN)
  Core: MPTAESTGM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPVQXPTXEXTGXTPE

SEQ ID NO: 339807 - protein, 21 aa, Artificial Sequence
  Description of Artificial Sequence: Synthetic peptide
  Seed: VISTAPVQMPTAESTGMTPEK (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTGMTPEK

SEQ ID NO: 339808 - protein, 21 aa, Artificial Sequence
  Description of Artificial Sequence: Synthetic peptide
  Seed: VISTAPVQMPTAESTGMTPEK (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTPEK

SEQ ID NO: 339809 - protein, 22 aa, Artificial Sequence
  Description of Artificial Sequence: Synthetic peptide
  Seed: VISTAPVQMPTAESTGMTPEKV (PMEL_HUMAN)
  Core: TAPVQMPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VISXAPXQXPTXESTGMTPEKV

SEQ ID NO: 339810 - protein, 22 aa, Artificial Sequence
  Description of Artificial Sequence: Synthetic peptide
  Seed: VISTAPVQMPTAESTGMTPEKV (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTPEKV

SEQ ID NO: 339811 - protein, 23 aa, Artificial Sequence
  Description of Artificial Sequence: Synthetic peptide
  Seed: VISTAPVQMPTAESTGMTPEKVP (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTPEKVP

SEQ ID NO: 339812 - protein, 23 aa, Artificial Sequence
  Description of Artificial Sequence: Synthetic peptide
  Seed: VISTAPVQMPTAESTGMTPEKVP (PMEL_HUMAN)
  Core: STGMTPEKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPVQMPTAEXTGXTXEKXP

SEQ ID NO: 339813 - protein, 24 aa, Artificial Sequence
  Description of Artificial Sequence: Synthetic peptide
  Seed: VISTAPVQMPTAESTGMTPEKVPV (PMEL_HUMAN)
  Core: VQMPTAEST
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPXQMXTXESXGMTPEKVPV

SEQ ID NO: 339814 - protein, 24 aa, Artificial Sequence
  Description of Artificial Sequence: Synthetic peptide
  Seed: VISTAPVQMPTAESTGMTPEKVPV (PMEL_HUMAN)
  Core: STGMTPEKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPVQMPTAEXTGXTXEKXPV

SEQ ID NO: 339815 - protein, 25 aa, Artificial Sequence
  Description of Artificial Sequence: Synthetic peptide
  Seed: VISTAPVQMPTAESTGMTPEKVPVS (PMEL_HUMAN)
  Core: STGMTPEKV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VISTAPVQMPTAEXTGXTXEKXPVS

SEQ ID NO: 339816 - protein, 13 aa, Artificial Sequence
  Description of Artificial Sequence: Synthetic peptide
  Seed: VIWVNNTIINGSQ (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQ

SEQ ID NO: 339817 - protein, 13 aa, Artificial Sequence
  Description of Artificial Sequence: Synthetic peptide
  Seed: VIWVNNTIINGSQ (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQ

SEQ ID NO: 339818 - protein, 13 aa, Artificial Sequence
  Description of Artificial Sequence: Synthetic peptide
  Seed: VIWVNNTIINGSQ (PMEL_HUMAN)
  Core: VNNTIINGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VIWXNNXIXNGXQ

SEQ ID NO: 339819 - protein, 14 aa, Artificial Sequence
  Description of Artificial Sequence: Synthetic peptide
  Seed: VIWVNNTIINGSQV (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQV

SEQ ID NO: 339820 - protein, 14 aa, Artificial Sequence
  Description of Artificial Sequence: Synthetic peptide
  Seed: VIWVNNTIINGSQV (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQV

SEQ ID NO: 339821 - protein, 14 aa, Artificial Sequence
  Description of Artificial Sequence: Synthetic peptide
  Seed: VIWVNNTIINGSQV (PMEL_HUMAN)
  Core: VNNTIINGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VIWXNNXIXNGXQV

SEQ ID NO: 339822 - protein, 15 aa, Artificial Sequence
  Description of Artificial Sequence: Synthetic peptide
  Seed: VIWVNNTIINGSQVW (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVW

SEQ ID NO: 339823 - protein, 15 aa, Artificial Sequence
  Description of Artificial Sequence: Synthetic peptide
  Seed: VIWVNNTIINGSQVW (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVW

SEQ ID NO: 339824 - protein, 15 aa, Artificial Sequence
  Description of Artificial Sequence: Synthetic peptide
  Seed: VIWVNNTIINGSQVW (PMEL_HUMAN)
  Core: VNNTIINGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VIWXNNXIXNGXQVW

SEQ ID NO: 339825 - protein, 16 aa, Artificial Sequence
  Description of Artificial Sequence: Synthetic peptide
  Seed: VIWVNNTIINGSQVWG (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVWG

SEQ ID NO: 339826 - protein, 16 aa, Artificial Sequence
  Description of Artificial Sequence: Synthetic peptide
  Seed: VIWVNNTIINGSQVWG (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWG

SEQ ID NO: 339827 - protein, 16 aa, Artificial Sequence
  Description of Artificial Sequence: Synthetic peptide
  Seed: VIWVNNTIINGSQVWG (PMEL_HUMAN)
  Core: VNNTIINGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VIWXNNXIXNGXQVWG

SEQ ID NO: 339828 - protein, 17 aa, Artificial Sequence
  Description of Artificial Sequence: Synthetic peptide
  Seed: VIWVNNTIINGSQVWGG (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVWGG

SEQ ID NO: 339829 - protein, 17 aa, Artificial Sequence
  Description of Artificial Sequence: Synthetic peptide
  Seed: VIWVNNTIINGSQVWGG (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGG

SEQ ID NO: 339830 - protein, 17 aa, Artificial Sequence
  Description of Artificial Sequence: Synthetic peptide
  Seed: VIWVNNTIINGSQVWGG (PMEL_HUMAN)
  Core: NTIINGSQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNXTIXNXSQXWGG

SEQ ID NO: 339831 - protein, 17 aa, Artificial Sequence
  Description of Artificial Sequence: Synthetic peptide
  Seed: VIWVNNTIINGSQVWGG (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGX

SEQ ID NO: 339832 - protein, 18 aa, Artificial Sequence
  Description of Artificial Sequence: Synthetic peptide
  Seed: VIWVNNTIINGSQVWGGQ (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVWGGQ

SEQ ID NO: 339833 - protein, 18 aa, Artificial Sequence
  Description of Artificial Sequence: Synthetic peptide
  Seed: VIWVNNTIINGSQVWGGQ (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQ

SEQ ID NO: 339834 - protein, 19 aa, Artificial Sequence
  Description of Artificial Sequence: Synthetic peptide
  Seed: VIWVNNTIINGSQVWGGQP (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVWGGQP

SEQ ID NO: 339835 - protein, 19 aa, Artificial Sequence
  Description of Artificial Sequence: Synthetic peptide
  Seed: VIWVNNTIINGSQVWGGQP (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQP

SEQ ID NO: 339836 - protein, 20 aa, Artificial Sequence
  Description of Artificial Sequence: Synthetic peptide
  Seed: VIWVNNTIINGSQVWGGQPV (PMEL_HUMAN)
  Core: IWVNNTIIN
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXWVXNXIIXGSQVWGGQPV

SEQ ID NO: 339837 - protein, 20 aa, Artificial Sequence
  Description of Artificial Sequence: Synthetic peptide
  Seed: VIWVNNTIINGSQVWGGQPV (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPV

SEQ ID NO: 339838 - protein, 20 aa, Artificial Sequence
  Description of Artificial Sequence: Synthetic peptide
  Seed: VIWVNNTIINGSQVWGGQPV (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPV

SEQ ID NO: 339839 - protein, 21 aa, Artificial Sequence
  Description of Artificial Sequence: Synthetic peptide
  Seed: VIWVNNTIINGSQVWGGQPVY (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPVY

SEQ ID NO: 339840 - protein, 21 aa, Artificial Sequence
  Description of Artificial Sequence: Synthetic peptide
  Seed: VIWVNNTIINGSQVWGGQPVY (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPVY

SEQ ID NO: 339841 - protein, 22 aa, Artificial Sequence
  Description of Artificial Sequence: Synthetic peptide
  Seed: VIWVNNTIINGSQVWGGQPVYP (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPVYP

SEQ ID NO: 339842 - protein, 22 aa, Artificial Sequence
  Description of Artificial Sequence: Synthetic peptide
  Seed: VIWVNNTIINGSQVWGGQPVYP (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPVYP

SEQ ID NO: 339843 - protein, 23 aa, Artificial Sequence
  Description of Artificial Sequence: Synthetic peptide
  Seed: VIWVNNTIINGSQVWGGQPVYPQ (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPVYPQ

SEQ ID NO: 339844 - protein, 23 aa, Artificial Sequence
  Description of Artificial Sequence: Synthetic peptide
  Seed: VIWVNNTIINGSQVWGGQPVYPQ (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPVYPQ

SEQ ID NO: 339845 - protein, 24 aa, Artificial Sequence
  Description of Artificial Sequence: Synthetic peptide
  Seed: VIWVNNTIINGSQVWGGQPVYPQE (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPVYPQE

SEQ ID NO: 339846 - protein, 24 aa, Artificial Sequence
  Description of Artificial Sequence: Synthetic peptide
  Seed: VIWVNNTIINGSQVWGGQPVYPQE (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPVYPQE

SEQ ID NO: 339847 - protein, 25 aa, Artificial Sequence
  Description of Artificial Sequence: Synthetic peptide
  Seed: VIWVNNTIINGSQVWGGQPVYPQET (PMEL_HUMAN)
  Core: WVNNTIING
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VIXVNXTXINXSQVWGGQPVYPQET

SEQ ID NO: 339848 - protein, 25 aa, Artificial Sequence
  Description of Artificial Sequence: Synthetic peptide
  Seed: VIWVNNTIINGSQVWGGQPVYPQET (PMEL_HUMAN)
  Core: INGSQVWGG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIXNGXQXWGXQPVYPQET

SEQ ID NO: 339849 - protein, 25 aa, Artificial Sequence
  Description of Artificial Sequence: Synthetic peptide
  Seed: VIWVNNTIINGSQVWGGQPVYPQET (PMEL_HUMAN)
  Core: VWGGQPVYP
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VIWVNNTIINGSQXWGXQXVYXQET

SEQ ID NO: 339850 - protein, 14 aa, Artificial Sequence
  Description of Artificial Sequence: Synthetic peptide
  Seed: VKRQVPLDCVLYRY (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXY

SEQ ID NO: 339851 - protein, 15 aa, Artificial Sequence
  Description of Artificial Sequence: Synthetic peptide
  Seed: VKRQVPLDCVLYRYG (PMEL_HUMAN)
  Core: QVPLDCVLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKRXVPXDXVLXRYG

SEQ ID NO: 339852 - protein, 15 aa, Artificial Sequence
  Description of Artificial Sequence: Synthetic peptide
  Seed: VKRQVPLDCVLYRYG (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYG

SEQ ID NO: 339853 - protein, 15 aa, Artificial Sequence
  Description of Artificial Sequence: Synthetic peptide
  Seed: VKRQVPLDCVLYRYG (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYX

SEQ ID NO: 339854 - protein, 16 aa, Artificial Sequence
  Description of Artificial Sequence: Synthetic peptide
  Seed: VKRQVPLDCVLYRYGS (PMEL_HUMAN)
  Core: QVPLDCVLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKRXVPXDXVLXRYGS

SEQ ID NO: 339855 - protein, 16 aa, Artificial Sequence
  Description of Artificial Sequence: Synthetic peptide
  Seed: VKRQVPLDCVLYRYGS (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGS

SEQ ID NO: 339856 - protein, 16 aa, Artificial Sequence
  Description of Artificial Sequence: Synthetic peptide
  Seed: VKRQVPLDCVLYRYGS (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXS

SEQ ID NO: 339857 - protein, 17 aa, Artificial Sequence
  Description of Artificial Sequence: Synthetic peptide
  Seed: VKRQVPLDCVLYRYGSF (PMEL_HUMAN)
  Core: QVPLDCVLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKRXVPXDXVLXRYGSF

SEQ ID NO: 339858 - protein, 17 aa, Artificial Sequence
  Description of Artificial Sequence: Synthetic peptide
  Seed: VKRQVPLDCVLYRYGSF (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSF

SEQ ID NO: 339859 - protein, 17 aa, Artificial Sequence
  Description of Artificial Sequence: Synthetic peptide
  Seed: VKRQVPLDCVLYRYGSF (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSF

SEQ ID NO: 339860 - protein, 19 aa, Artificial Sequence
  Description of Artificial Sequence: Synthetic peptide
  Seed: VKRQVPLDCVLYRYGSFSV (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSV

SEQ ID NO: 339861 - protein, 19 aa, Artificial Sequence
  Description of Artificial Sequence: Synthetic peptide
  Seed: VKRQVPLDCVLYRYGSFSV (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSV

SEQ ID NO: 339862 - protein, 19 aa, Artificial Sequence
  Description of Artificial Sequence: Synthetic peptide
  Seed: VKRQVPLDCVLYRYGSFSV (PMEL_HUMAN)
  Core: CVLYRYGSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDXVLXRXGSXSV

SEQ ID NO: 339863 - protein, 19 aa, Artificial Sequence
  Description of Artificial Sequence: Synthetic peptide
  Seed: VKRQVPLDCVLYRYGSFSV (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSX

SEQ ID NO: 339864 - protein, 20 aa, Artificial Sequence
  Description of Artificial Sequence: Synthetic peptide
  Seed: VKRQVPLDCVLYRYGSFSVT (PMEL_HUMAN)
  Core: QVPLDCVLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKRXVPXDXVLXRYGSFSVT

SEQ ID NO: 339865 - protein, 20 aa, Artificial Sequence
  Description of Artificial Sequence: Synthetic peptide
  Seed: VKRQVPLDCVLYRYGSFSVT (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVT

SEQ ID NO: 339866 - protein, 20 aa, Artificial Sequence
  Description of Artificial Sequence: Synthetic peptide
  Seed: VKRQVPLDCVLYRYGSFSVT (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVT

SEQ ID NO: 339867 - protein, 20 aa, Artificial Sequence
  Description of Artificial Sequence: Synthetic peptide
  Seed: VKRQVPLDCVLYRYGSFSVT (PMEL_HUMAN)
  Core: CVLYRYGSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDXVLXRXGSXSVT

SEQ ID NO: 339868 - protein, 20 aa, Artificial Sequence
  Description of Artificial Sequence: Synthetic peptide
  Seed: VKRQVPLDCVLYRYGSFSVT (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXT

SEQ ID NO: 339869 - protein, 20 aa, Artificial Sequence
  Description of Artificial Sequence: Synthetic peptide
  Seed: VKRQVPLDCVLYRYGSFSVT (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVX

SEQ ID NO: 339870 - protein, 21 aa, Artificial Sequence
  Description of Artificial Sequence: Synthetic peptide
  Seed: VKRQVPLDCVLYRYGSFSVTL (PMEL_HUMAN)
  Core: QVPLDCVLY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VKRXVPXDXVLXRYGSFSVTL

SEQ ID NO: 339871 - protein, 21 aa, Artificial Sequence
  Description of Artificial Sequence: Synthetic peptide
  Seed: VKRQVPLDCVLYRYGSFSVTL (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVTL

SEQ ID NO: 339872 - protein, 21 aa, Artificial Sequence
  Description of Artificial Sequence: Synthetic peptide
  Seed: VKRQVPLDCVLYRYGSFSVTL (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVTL

SEQ ID NO: 339873 - protein, 21 aa, Artificial Sequence
  Description of Artificial Sequence: Synthetic peptide
  Seed: VKRQVPLDCVLYRYGSFSVTL (PMEL_HUMAN)
  Core: CVLYRYGSF
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDXVLXRXGSXSVTL

SEQ ID NO: 339874 - protein, 21 aa, Artificial Sequence
  Description of Artificial Sequence: Synthetic peptide
  Seed: VKRQVPLDCVLYRYGSFSVTL (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXTL

SEQ ID NO: 339875 - protein, 21 aa, Artificial Sequence
  Description of Artificial Sequence: Synthetic peptide
  Seed: VKRQVPLDCVLYRYGSFSVTL (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVXL

SEQ ID NO: 339876 - protein, 22 aa, Artificial Sequence
  Description of Artificial Sequence: Synthetic peptide
  Seed: VKRQVPLDCVLYRYGSFSVTLD (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVTLD

SEQ ID NO: 339877 - protein, 22 aa, Artificial Sequence
  Description of Artificial Sequence: Synthetic peptide
  Seed: VKRQVPLDCVLYRYGSFSVTLD (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVTLD

SEQ ID NO: 339878 - protein, 22 aa, Artificial Sequence
  Description of Artificial Sequence: Synthetic peptide
  Seed: VKRQVPLDCVLYRYGSFSVTLD (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXTLD

SEQ ID NO: 339879 - protein, 22 aa, Artificial Sequence
  Description of Artificial Sequence: Synthetic peptide
  Seed: VKRQVPLDCVLYRYGSFSVTLD (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVXLD

SEQ ID NO: 339880 - protein, 22 aa, Artificial Sequence
  Description of Artificial Sequence: Synthetic peptide
  Seed: VKRQVPLDCVLYRYGSFSVTLD (PMEL_HUMAN)
  Core: RYGSFSVTL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYXYGXFXVTXD

SEQ ID NO: 339881 - protein, 22 aa, Artificial Sequence
  Description of Artificial Sequence: Synthetic peptide
  Seed: VKRQVPLDCVLYRYGSFSVTLD (PMEL_HUMAN)
  Core: YGSFSVTLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYRXGSXSXTLX

SEQ ID NO: 339882 - protein, 23 aa, Artificial Sequence
  Description of Artificial Sequence: Synthetic peptide
  Seed: VKRQVPLDCVLYRYGSFSVTLDI (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVTLDI

SEQ ID NO: 339883 - protein, 23 aa, Artificial Sequence
  Description of Artificial Sequence: Synthetic peptide
  Seed: VKRQVPLDCVLYRYGSFSVTLDI (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVTLDI

SEQ ID NO: 339884 - protein, 23 aa, Artificial Sequence
  Description of Artificial Sequence: Synthetic peptide
  Seed: VKRQVPLDCVLYRYGSFSVTLDI (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXTLDI

SEQ ID NO: 339885 - protein, 23 aa, Artificial Sequence
  Description of Artificial Sequence: Synthetic peptide
  Seed: VKRQVPLDCVLYRYGSFSVTLDI (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVXLDI

SEQ ID NO: 339886 - protein, 23 aa, Artificial Sequence
  Description of Artificial Sequence: Synthetic peptide
  Seed: VKRQVPLDCVLYRYGSFSVTLDI (PMEL_HUMAN)
  Core: RYGSFSVTL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYXYGXFXVTXDI

SEQ ID NO: 339887 - protein, 23 aa, Artificial Sequence
  Description of Artificial Sequence: Synthetic peptide
  Seed: VKRQVPLDCVLYRYGSFSVTLDI (PMEL_HUMAN)
  Core: YGSFSVTLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYRXGSXSXTLXI

SEQ ID NO: 339888 - protein, 24 aa, Artificial Sequence
  Description of Artificial Sequence: Synthetic peptide
  Seed: VKRQVPLDCVLYRYGSFSVTLDIV (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVTLDIV

SEQ ID NO: 339889 - protein, 24 aa, Artificial Sequence
  Description of Artificial Sequence: Synthetic peptide
  Seed: VKRQVPLDCVLYRYGSFSVTLDIV (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVTLDIV

SEQ ID NO: 339890 - protein, 24 aa, Artificial Sequence
  Description of Artificial Sequence: Synthetic peptide
  Seed: VKRQVPLDCVLYRYGSFSVTLDIV (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXTLDIV

SEQ ID NO: 339891 - protein, 24 aa, Artificial Sequence
  Description of Artificial Sequence: Synthetic peptide
  Seed: VKRQVPLDCVLYRYGSFSVTLDIV (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVXLDIV

SEQ ID NO: 339892 - protein, 24 aa, Artificial Sequence
  Description of Artificial Sequence: Synthetic peptide
  Seed: VKRQVPLDCVLYRYGSFSVTLDIV (PMEL_HUMAN)
  Core: RYGSFSVTL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYXYGXFXVTXDIV

SEQ ID NO: 339893 - protein, 24 aa, Artificial Sequence
  Description of Artificial Sequence: Synthetic peptide
  Seed: VKRQVPLDCVLYRYGSFSVTLDIV (PMEL_HUMAN)
  Core: YGSFSVTLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYRXGSXSXTLXIV

SEQ ID NO: 339894 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: VPLDCVLYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VKRQXPLXCXLYXYGSFSVTLDIVQ

SEQ ID NO: 339895 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: LDCVLYRYG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPXDCXLXRYXSFSVTLDIVQ

SEQ ID NO: 339896 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: LYRYGSFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVXYRXGXFSXTLDIVQ

SEQ ID NO: 339897 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: YRYGSFSVT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLXRYXSXSVXLDIVQ

SEQ ID NO: 339898 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: RYGSFSVTL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYXYGXFXVTXDIVQ

SEQ ID NO: 339899 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: YGSFSVTLD
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYRXGSXSXTLXIVQ

SEQ ID NO: 339900 - protein, 25 aa, Artificial Sequence
  Description of Artificial Sequence: Synthetic peptide
  Seed: VKRQVPLDCVLYRYGSFSVTLDIVQ (PMEL_HUMAN)
  Core: SFSVTLDIV
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VKRQVPLDCVLYRYGXFSXTXDIXQ

SEQ ID NO: 339901 - protein, 13 aa, Artificial Sequence
  Description of Artificial Sequence: Synthetic peptide
  Seed: VLASLIYRRRLMK (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMK

SEQ ID NO: 339902 - protein, 13 aa, Artificial Sequence
  Description of Artificial Sequence: Synthetic peptide
  Seed: VLASLIYRRRLMK (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXK

SEQ ID NO: 339903 - protein, 13 aa, Artificial Sequence
  Description of Artificial Sequence: Synthetic peptide
  Seed: VLASLIYRRRLMK (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMX

SEQ ID NO: 339904 - protein, 14 aa, Artificial Sequence
  Description of Artificial Sequence: Synthetic peptide
  Seed: VLASLIYRRRLMKQ (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQ

SEQ ID NO: 339905 - protein, 14 aa, Artificial Sequence
  Description of Artificial Sequence: Synthetic peptide
  Seed: VLASLIYRRRLMKQ (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQ

SEQ ID NO: 339906 - protein, 14 aa, Artificial Sequence
  Description of Artificial Sequence: Synthetic peptide
  Seed: VLASLIYRRRLMKQ (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQ

SEQ ID NO: 339907 - protein, 14 aa, Artificial Sequence
  Description of Artificial Sequence: Synthetic peptide
  Seed: VLASLIYRRRLMKQ (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKX

SEQ ID NO: 339908 - protein, 15 aa, Artificial Sequence
  Description of Artificial Sequence: Synthetic peptide
  Seed: VLASLIYRRRLMKQD (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQD

SEQ ID NO: 339909 - protein, 15 aa, Artificial Sequence
  Description of Artificial Sequence: Synthetic peptide
  Seed: VLASLIYRRRLMKQD (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQD

SEQ ID NO: 339910 - protein, 15 aa, Artificial Sequence
  Description of Artificial Sequence: Synthetic peptide
  Seed: VLASLIYRRRLMKQD (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQD

SEQ ID NO: 339911 - protein, 15 aa, Artificial Sequence
  Description of Artificial Sequence: Synthetic peptide
  Seed: VLASLIYRRRLMKQD (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXD

SEQ ID NO: 339912 - protein, 15 aa, Artificial Sequence
  Description of Artificial Sequence: Synthetic peptide
  Seed: VLASLIYRRRLMKQD (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQX

SEQ ID NO: 339913 - protein, 16 aa, Artificial Sequence
  Description of Artificial Sequence: Synthetic peptide
  Seed: VLASLIYRRRLMKQDF (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDF

SEQ ID NO: 339914 - protein, 16 aa, Artificial Sequence
  Description of Artificial Sequence: Synthetic peptide
  Seed: VLASLIYRRRLMKQDF (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDF

SEQ ID NO: 339915 - protein, 16 aa, Artificial Sequence
  Description of Artificial Sequence: Synthetic peptide
  Seed: VLASLIYRRRLMKQDF (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDF

SEQ ID NO: 339916 - protein, 16 aa, Artificial Sequence
  Description of Artificial Sequence: Synthetic peptide
  Seed: VLASLIYRRRLMKQDF (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDF

SEQ ID NO: 339917 - protein, 16 aa, Artificial Sequence
  Description of Artificial Sequence: Synthetic peptide
  Seed: VLASLIYRRRLMKQDF (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXF

SEQ ID NO: 339918 - protein, 17 aa, Artificial Sequence
  Description of Artificial Sequence: Synthetic peptide
  Seed: VLASLIYRRRLMKQDFS (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDFS

SEQ ID NO: 339919 - protein, 17 aa, Artificial Sequence
  Description of Artificial Sequence: Synthetic peptide
  Seed: VLASLIYRRRLMKQDFS (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFS

SEQ ID NO: 339920 - protein, 17 aa, Artificial Sequence
  Description of Artificial Sequence: Synthetic peptide
  Seed: VLASLIYRRRLMKQDFS (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFS

SEQ ID NO: 339921 - protein, 17 aa, Artificial Sequence
  Description of Artificial Sequence: Synthetic peptide
  Seed: VLASLIYRRRLMKQDFS (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFS

SEQ ID NO: 339922 - protein, 17 aa, Artificial Sequence
  Description of Artificial Sequence: Synthetic peptide
  Seed: VLASLIYRRRLMKQDFS (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFS

SEQ ID NO: 339923 - protein, 18 aa, Artificial Sequence
  Description of Artificial Sequence: Synthetic peptide
  Seed: VLASLIYRRRLMKQDFSV (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDFSV

SEQ ID NO: 339924 - protein, 18 aa, Artificial Sequence
  Description of Artificial Sequence: Synthetic peptide
  Seed: VLASLIYRRRLMKQDFSV (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSV

SEQ ID NO: 339925 - protein, 18 aa, Artificial Sequence
  Description of Artificial Sequence: Synthetic peptide
  Seed: VLASLIYRRRLMKQDFSV (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSV

SEQ ID NO: 339926 - protein, 18 aa, Artificial Sequence
  Description of Artificial Sequence: Synthetic peptide
  Seed: VLASLIYRRRLMKQDFSV (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSV

SEQ ID NO: 339927 - protein, 19 aa, Artificial Sequence
  Description of Artificial Sequence: Synthetic peptide
  Seed: VLASLIYRRRLMKQDFSVP (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDFSVP

SEQ ID NO: 339928 - protein, 19 aa, Artificial Sequence
  Description of Artificial Sequence: Synthetic peptide
  Seed: VLASLIYRRRLMKQDFSVP (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVP

SEQ ID NO: 339929 - protein, 19 aa, Artificial Sequence
  Description of Artificial Sequence: Synthetic peptide
  Seed: VLASLIYRRRLMKQDFSVP (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVP

SEQ ID NO: 339930 - protein, 19 aa, Artificial Sequence
  Description of Artificial Sequence: Synthetic peptide
  Seed: VLASLIYRRRLMKQDFSVP (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVP

SEQ ID NO: 339931 - protein, 19 aa, Artificial Sequence
  Description of Artificial Sequence: Synthetic peptide
  Seed: VLASLIYRRRLMKQDFSVP (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVP

SEQ ID NO: 339932 - protein, 19 aa, Artificial Sequence
  Description of Artificial Sequence: Synthetic peptide
  Seed: VLASLIYRRRLMKQDFSVP (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVP

SEQ ID NO: 339933 - protein, 19 aa, Artificial Sequence
  Description of Artificial Sequence: Synthetic peptide
  Seed: VLASLIYRRRLMKQDFSVP (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXP

SEQ ID NO: 339934 - protein, 20 aa, Artificial Sequence
  Description of Artificial Sequence: Synthetic peptide
  Seed: VLASLIYRRRLMKQDFSVPQ (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDFSVPQ

SEQ ID NO: 339935 - protein, 20 aa, Artificial Sequence
  Description of Artificial Sequence: Synthetic peptide
  Seed: VLASLIYRRRLMKQDFSVPQ (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQ

SEQ ID NO: 339936 - protein, 20 aa, Artificial Sequence
  Description of Artificial Sequence: Synthetic peptide
  Seed: VLASLIYRRRLMKQDFSVPQ (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQ

SEQ ID NO: 339937 - protein, 20 aa, Artificial Sequence
  Description of Artificial Sequence: Synthetic peptide
  Seed: VLASLIYRRRLMKQDFSVPQ (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQ

SEQ ID NO: 339938 - protein, 20 aa, Artificial Sequence
  Description of Artificial Sequence: Synthetic peptide
  Seed: VLASLIYRRRLMKQDFSVPQ (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQ

SEQ ID NO: 339939 - protein, 20 aa, Artificial Sequence
  Description of Artificial Sequence: Synthetic peptide
  Seed: VLASLIYRRRLMKQDFSVPQ (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQ

SEQ ID NO: 339940 - protein, 20 aa, Artificial Sequence
  Description of Artificial Sequence: Synthetic peptide
  Seed: VLASLIYRRRLMKQDFSVPQ (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQ

SEQ ID NO: 339941 - protein, 20 aa, Artificial Sequence
  Description of Artificial Sequence: Synthetic peptide
  Seed: VLASLIYRRRLMKQDFSVPQ (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQ

SEQ ID NO: 339942 - protein, 20 aa, Artificial Sequence
  Description of Artificial Sequence: Synthetic peptide
  Seed: VLASLIYRRRLMKQDFSVPQ (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPX

SEQ ID NO: 339943 - protein, 21 aa, Artificial Sequence
  Description of Artificial Sequence: Synthetic peptide
  Seed: VLASLIYRRRLMKQDFSVPQL (PMEL_HUMAN)
  Core: LASLIYRRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXASXIXRRXLMKQDFSVPQL

SEQ ID NO: 339944 - protein, 21 aa, Artificial Sequence
  Description of Artificial Sequence: Synthetic peptide
  Seed: VLASLIYRRRLMKQDFSVPQL (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQL

SEQ ID NO: 339945 - protein, 21 aa, Artificial Sequence
  Description of Artificial Sequence: Synthetic peptide
  Seed: VLASLIYRRRLMKQDFSVPQL (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQL

SEQ ID NO: 339946 - protein, 21 aa, Artificial Sequence
  Description of Artificial Sequence: Synthetic peptide
  Seed: VLASLIYRRRLMKQDFSVPQL (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQL

SEQ ID NO: 339947 - protein, 21 aa, Artificial Sequence
  Description of Artificial Sequence: Synthetic peptide
  Seed: VLASLIYRRRLMKQDFSVPQL (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQL

SEQ ID NO: 339948 - protein, 21 aa, Artificial Sequence
  Description of Artificial Sequence: Synthetic peptide
  Seed: VLASLIYRRRLMKQDFSVPQL (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQL

SEQ ID NO: 339949 - protein, 21 aa, Artificial Sequence
  Description of Artificial Sequence: Synthetic peptide
  Seed: VLASLIYRRRLMKQDFSVPQL (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQL

SEQ ID NO: 339950 - protein, 21 aa, Artificial Sequence
  Description of Artificial Sequence: Synthetic peptide
  Seed: VLASLIYRRRLMKQDFSVPQL (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQL

SEQ ID NO: 339951 - protein, 21 aa, Artificial Sequence
  Description of Artificial Sequence: Synthetic peptide
  Seed: VLASLIYRRRLMKQDFSVPQL (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPXL

SEQ ID NO: 339952 - protein, 22 aa, Artificial Sequence
  Description of Artificial Sequence: Synthetic peptide
  Seed: VLASLIYRRRLMKQDFSVPQLP (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQLP

SEQ ID NO: 339953 - protein, 22 aa, Artificial Sequence
  Description of Artificial Sequence: Synthetic peptide
  Seed: VLASLIYRRRLMKQDFSVPQLP (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQLP

SEQ ID NO: 339954 - protein, 22 aa, Artificial Sequence
  Description of Artificial Sequence: Synthetic peptide
  Seed: VLASLIYRRRLMKQDFSVPQLP (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQLP

SEQ ID NO: 339955 - protein, 22 aa, Artificial Sequence
  Description of Artificial Sequence: Synthetic peptide
  Seed: VLASLIYRRRLMKQDFSVPQLP (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQLP

SEQ ID NO: 339956 - protein, 22 aa, Artificial Sequence
  Description of Artificial Sequence: Synthetic peptide
  Seed: VLASLIYRRRLMKQDFSVPQLP (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQLP

SEQ ID NO: 339957 - protein, 22 aa, Artificial Sequence
  Description of Artificial Sequence: Synthetic peptide
  Seed: VLASLIYRRRLMKQDFSVPQLP (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQLP

SEQ ID NO: 339958 - protein, 22 aa, Artificial Sequence
  Description of Artificial Sequence: Synthetic peptide
  Seed: VLASLIYRRRLMKQDFSVPQLP (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQLP

SEQ ID NO: 339959 - protein, 22 aa, Artificial Sequence
  Description of Artificial Sequence: Synthetic peptide
  Seed: VLASLIYRRRLMKQDFSVPQLP (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPXLP

SEQ ID NO: 339960 - protein, 23 aa, Artificial Sequence
  Description of Artificial Sequence: Synthetic peptide
  Seed: VLASLIYRRRLMKQDFSVPQLPH (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQLPH

SEQ ID NO: 339961 - protein, 23 aa, Artificial Sequence
  Description of Artificial Sequence: Synthetic peptide
  Seed: VLASLIYRRRLMKQDFSVPQLPH (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQLPH

SEQ ID NO: 339962 - protein, 23 aa, Artificial Sequence
  Description of Artificial Sequence: Synthetic peptide
  Seed: VLASLIYRRRLMKQDFSVPQLPH (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQLPH

SEQ ID NO: 339963 - protein, 23 aa, Artificial Sequence
  Description of Artificial Sequence: Synthetic peptide
  Seed: VLASLIYRRRLMKQDFSVPQLPH (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQLPH

SEQ ID NO: 339964 - protein, 23 aa, Artificial Sequence
  Description of Artificial Sequence: Synthetic peptide
  Seed: VLASLIYRRRLMKQDFSVPQLPH (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQLPH

SEQ ID NO: 339965 - protein, 23 aa, Artificial Sequence
  Description of Artificial Sequence: Synthetic peptide
  Seed: VLASLIYRRRLMKQDFSVPQLPH (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQLPH

SEQ ID NO: 339966 - protein, 23 aa, Artificial Sequence
  Description of Artificial Sequence: Synthetic peptide
  Seed: VLASLIYRRRLMKQDFSVPQLPH (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQLPH

SEQ ID NO: 339967 - protein, 23 aa, Artificial Sequence
  Description of Artificial Sequence: Synthetic peptide
  Seed: VLASLIYRRRLMKQDFSVPQLPH (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPXLPH

SEQ ID NO: 339968 - protein, 24 aa, Artificial Sequence
  Description of Artificial Sequence: Synthetic peptide
  Seed: VLASLIYRRRLMKQDFSVPQLPHS (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQLPHS

SEQ ID NO: 339969 - protein, 24 aa, Artificial Sequence
  Description of Artificial Sequence: Synthetic peptide
  Seed: VLASLIYRRRLMKQDFSVPQLPHS (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQLPHS

SEQ ID NO: 339970 - protein, 24 aa, Artificial Sequence
  Description of Artificial Sequence: Synthetic peptide
  Seed: VLASLIYRRRLMKQDFSVPQLPHS (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQLPHS

SEQ ID NO: 339971 - protein, 24 aa, Artificial Sequence
  Description of Artificial Sequence: Synthetic peptide
  Seed: VLASLIYRRRLMKQDFSVPQLPHS (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQLPHS

SEQ ID NO: 339972 - protein, 24 aa, Artificial Sequence
  Description of Artificial Sequence: Synthetic peptide
  Seed: VLASLIYRRRLMKQDFSVPQLPHS (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQLPHS

SEQ ID NO: 339973 - protein, 24 aa, Artificial Sequence
  Description of Artificial Sequence: Synthetic peptide
  Seed: VLASLIYRRRLMKQDFSVPQLPHS (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQLPHS

SEQ ID NO: 339974 - protein, 24 aa, Artificial Sequence
  Description of Artificial Sequence: Synthetic peptide
  Seed: VLASLIYRRRLMKQDFSVPQLPHS (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQLPHS

SEQ ID NO: 339975 - protein, 24 aa, Artificial Sequence
  Description of Artificial Sequence: Synthetic peptide
  Seed: VLASLIYRRRLMKQDFSVPQLPHS (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPXLPHS

SEQ ID NO: 339976 - protein, 25 aa, Artificial Sequence
  Description of Artificial Sequence: Synthetic peptide
  Seed: VLASLIYRRRLMKQDFSVPQLPHSS (PMEL_HUMAN)
  Core: SLIYRRRLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLAXLIXRXRLXKQDFSVPQLPHSS

SEQ ID NO: 339977 - protein, 25 aa, Artificial Sequence
  Description of Artificial Sequence: Synthetic peptide
  Seed: VLASLIYRRRLMKQDFSVPQLPHSS (PMEL_HUMAN)
  Core: LIYRRRLMK
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLASXIYXRXLMXQDFSVPQLPHSS

SEQ ID NO: 339978 - protein, 25 aa, Artificial Sequence
  Description of Artificial Sequence: Synthetic peptide
  Seed: VLASLIYRRRLMKQDFSVPQLPHSS (PMEL_HUMAN)
  Core: IYRRRLMKQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLASLXYRXRXMKXDFSVPQLPHSS

SEQ ID NO: 339979 - protein, 25 aa, Artificial Sequence
  Description of Artificial Sequence: Synthetic peptide
  Seed: VLASLIYRRRLMKQDFSVPQLPHSS (PMEL_HUMAN)
  Core: YRRRLMKQD
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIXRRXLXKQXFSVPQLPHSS

SEQ ID NO: 339980 - protein, 25 aa, Artificial Sequence
  Description of Artificial Sequence: Synthetic peptide
  Seed: VLASLIYRRRLMKQDFSVPQLPHSS (PMEL_HUMAN)
  Core: RRLMKQDFS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRXRLXKXDFXVPQLPHSS

SEQ ID NO: 339981 - protein, 25 aa, Artificial Sequence
  Description of Artificial Sequence: Synthetic peptide
  Seed: VLASLIYRRRLMKQDFSVPQLPHSS (PMEL_HUMAN)
  Core: RLMKQDFSV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRXLMXQXFSXPQLPHSS

SEQ ID NO: 339982 - protein, 25 aa, Artificial Sequence
  Description of Artificial Sequence: Synthetic peptide
  Seed: VLASLIYRRRLMKQDFSVPQLPHSS (PMEL_HUMAN)
  Core: LMKQDFSVP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRXMKXDXSVXQLPHSS

SEQ ID NO: 339983 - protein, 25 aa, Artificial Sequence
  Description of Artificial Sequence: Synthetic peptide
  Seed: VLASLIYRRRLMKQDFSVPQLPHSS (PMEL_HUMAN)
  Core: MKQDFSVPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLXKQXFXVPXLPHSS

SEQ ID NO: 339984 - protein, 25 aa, Artificial Sequence
  Description of Artificial Sequence: Synthetic peptide
  Seed: VLASLIYRRRLMKQDFSVPQLPHSS (PMEL_HUMAN)
  Core: FSVPQLPHS
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VLASLIYRRRLMKQDXSVXQXPHXS

SEQ ID NO: 339985 - protein, 13 aa, Artificial Sequence
  Description of Artificial Sequence: Synthetic peptide
  Seed: VLGGPVSGLSIGT (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGX

SEQ ID NO: 339986 - protein, 14 aa, Artificial Sequence
  Description of Artificial Sequence: Synthetic peptide
  Seed: VLGGPVSGLSIGTG (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXG

SEQ ID NO: 339987 - protein, 15 aa, Artificial Sequence
  Description of Artificial Sequence: Synthetic peptide
  Seed: VLGGPVSGLSIGTGR (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGR

SEQ ID NO: 339988 - protein, 15 aa, Artificial Sequence
  Description of Artificial Sequence: Synthetic peptide
  Seed: VLGGPVSGLSIGTGR (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXR

SEQ ID NO: 339989 - protein, 16 aa, Artificial Sequence
  Description of Artificial Sequence: Synthetic peptide
  Seed: VLGGPVSGLSIGTGRA (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGRA

SEQ ID NO: 339990 - protein, 16 aa, Artificial Sequence
  Description of Artificial Sequence: Synthetic peptide
  Seed: VLGGPVSGLSIGTGRA (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRA

SEQ ID NO: 339991 - protein, 17 aa, Artificial Sequence
  Description of Artificial Sequence: Synthetic peptide
  Seed: VLGGPVSGLSIGTGRAM (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGRAM

SEQ ID NO: 339992 - protein, 17 aa, Artificial Sequence
  Description of Artificial Sequence: Synthetic peptide
  Seed: VLGGPVSGLSIGTGRAM (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAM

SEQ ID NO: 339993 - protein, 17 aa, Artificial Sequence
  Description of Artificial Sequence: Synthetic peptide
  Seed: VLGGPVSGLSIGTGRAM (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAX

SEQ ID NO: 339994 - protein, 18 aa, Artificial Sequence
  Description of Artificial Sequence: Synthetic peptide
  Seed: VLGGPVSGLSIGTGRAML (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGRAML

SEQ ID NO: 339995 - protein, 18 aa, Artificial Sequence
  Description of Artificial Sequence: Synthetic peptide
  Seed: VLGGPVSGLSIGTGRAML (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAML

SEQ ID NO: 339996 - protein, 19 aa, Artificial Sequence
  Description of Artificial Sequence: Synthetic peptide
  Seed: VLGGPVSGLSIGTGRAMLG (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGRAMLG

SEQ ID NO: 339997 - protein, 19 aa, Artificial Sequence
  Description of Artificial Sequence: Synthetic peptide
  Seed: VLGGPVSGLSIGTGRAMLG (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAMLG

SEQ ID NO: 339998 - protein, 19 aa, Artificial Sequence
  Description of Artificial Sequence: Synthetic peptide
  Seed: VLGGPVSGLSIGTGRAMLG (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLG

SEQ ID NO: 339999 - protein, 20 aa, Artificial Sequence
  Description of Artificial Sequence: Synthetic peptide
  Seed: VLGGPVSGLSIGTGRAMLGT (PMEL_HUMAN)
  Core: PVSGLSIGT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLGGXVSXLXIGXGRAMLGT

SEQ ID NO: 340000 - protein, 20 aa, Artificial Sequence
  Description of Artificial Sequence: Synthetic peptide
  Seed: VLGGPVSGLSIGTGRAMLGT (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAMLGT

SEQ ID NO: 340001 - protein, 20 aa, Artificial Sequence
  Description of Artificial Sequence: Synthetic peptide
  Seed: VLGGPVSGLSIGTGRAMLGT (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGT

SEQ ID NO: 340002 - protein, 20 aa, Artificial Sequence
  Description of Artificial Sequence: Synthetic peptide
  Seed: VLGGPVSGLSIGTGRAMLGT (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXT

SEQ ID NO: 340003 - protein, 21 aa, Artificial Sequence
  Description of Artificial Sequence: Synthetic peptide
  Seed: VLGGPVSGLSIGTGRAMLGTH (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGTH

SEQ ID NO: 340004 - protein, 21 aa, Artificial Sequence
  Description of Artificial Sequence: Synthetic peptide
  Seed: VLGGPVSGLSIGTGRAMLGTH (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXTH

SEQ ID NO: 340005 - protein, 22 aa, Artificial Sequence
  Description of Artificial Sequence: Synthetic peptide
  Seed: VLGGPVSGLSIGTGRAMLGTHT (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGTHT

SEQ ID NO: 340006 - protein, 22 aa, Artificial Sequence
  Description of Artificial Sequence: Synthetic peptide
  Seed: VLGGPVSGLSIGTGRAMLGTHT (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXTHT

SEQ ID NO: 340007 - protein, 23 aa, Artificial Sequence
  Description of Artificial Sequence: Synthetic peptide
  Seed: VLGGPVSGLSIGTGRAMLGTHTM (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAMLGTHTM

SEQ ID NO: 340008 - protein, 23 aa, Artificial Sequence
  Description of Artificial Sequence: Synthetic peptide
  Seed: VLGGPVSGLSIGTGRAMLGTHTM (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGTHTM

SEQ ID NO: 340009 - protein, 23 aa, Artificial Sequence
  Description of Artificial Sequence: Synthetic peptide
  Seed: VLGGPVSGLSIGTGRAMLGTHTM (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXTHTM

SEQ ID NO: 340010 - protein, 24 aa, Artificial Sequence
  Description of Artificial Sequence: Synthetic peptide
  Seed: VLGGPVSGLSIGTGRAMLGTHTME (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAMLGTHTME

SEQ ID NO: 340011 - protein, 24 aa, Artificial Sequence
  Description of Artificial Sequence: Synthetic peptide
  Seed: VLGGPVSGLSIGTGRAMLGTHTME (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGTHTME

SEQ ID NO: 340012 - protein, 24 aa, Artificial Sequence
  Description of Artificial Sequence: Synthetic peptide
  Seed: VLGGPVSGLSIGTGRAMLGTHTME (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXTHTME

SEQ ID NO: 340013 - protein, 25 aa, Artificial Sequence
  Description of Artificial Sequence: Synthetic peptide
  Seed: VLGGPVSGLSIGTGRAMLGTHTMEV (PMEL_HUMAN)
  Core: VSGLSIGTG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPXSGXSXGTXRAMLGTHTMEV

SEQ ID NO: 340014 - protein, 25 aa, Artificial Sequence
  Description of Artificial Sequence: Synthetic peptide
  Seed: VLGGPVSGLSIGTGRAMLGTHTMEV (PMEL_HUMAN)
  Core: LSIGTGRAM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGXSIXTXRAXLGTHTMEV

SEQ ID NO: 340015 - protein, 25 aa, Artificial Sequence
  Description of Artificial Sequence: Synthetic peptide
  Seed: VLGGPVSGLSIGTGRAMLGTHTMEV (PMEL_HUMAN)
  Core: IGTGRAMLG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSXGTXRXMLXTHTMEV

SEQ ID NO: 340016 - protein, 25 aa, Artificial Sequence
  Description of Artificial Sequence: Synthetic peptide
  Seed: VLGGPVSGLSIGTGRAMLGTHTMEV (PMEL_HUMAN)
  Core: MLGTHTMEV
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
VLGGPVSGLSIGTGRAXLGXHXMEX

SEQ ID NO: 340017 - protein, 14 aa, Artificial Sequence
  Description of Artificial Sequence: Synthetic peptide
  Seed: VLHQILKGGSGTYC (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYC

SEQ ID NO: 340018 - protein, 15 aa, Artificial Sequence
  Description of Artificial Sequence: Synthetic peptide
  Seed: VLHQILKGGSGTYCL (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCL

SEQ ID NO: 340019 - protein, 15 aa, Artificial Sequence
  Description of Artificial Sequence: Synthetic peptide
  Seed: VLHQILKGGSGTYCL (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXL

SEQ ID NO: 340020 - protein, 16 aa, Artificial Sequence
  Description of Artificial Sequence: Synthetic peptide
  Seed: VLHQILKGGSGTYCLN (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLN

SEQ ID NO: 340021 - protein, 16 aa, Artificial Sequence
  Description of Artificial Sequence: Synthetic peptide
  Seed: VLHQILKGGSGTYCLN (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXLN

SEQ ID NO: 340022 - protein, 17 aa, Artificial Sequence
  Description of Artificial Sequence: Synthetic peptide
  Seed: VLHQILKGGSGTYCLNV (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNV

SEQ ID NO: 340023 - protein, 17 aa, Artificial Sequence
  Description of Artificial Sequence: Synthetic peptide
  Seed: VLHQILKGGSGTYCLNV (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXLNV

SEQ ID NO: 340024 - protein, 19 aa, Artificial Sequence
  Description of Artificial Sequence: Synthetic peptide
  Seed: VLHQILKGGSGTYCLNVSL (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNVSL

SEQ ID NO: 340025 - protein, 19 aa, Artificial Sequence
  Description of Artificial Sequence: Synthetic peptide
  Seed: VLHQILKGGSGTYCLNVSL (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXLNVSL

SEQ ID NO: 340026 - protein, 20 aa, Artificial Sequence
  Description of Artificial Sequence: Synthetic peptide
  Seed: VLHQILKGGSGTYCLNVSLA (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNVSLA

SEQ ID NO: 340027 - protein, 20 aa, Artificial Sequence
  Description of Artificial Sequence: Synthetic peptide
  Seed: VLHQILKGGSGTYCLNVSLA (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXLNVSLA

SEQ ID NO: 340028 - protein, 20 aa, Artificial Sequence
  Description of Artificial Sequence: Synthetic peptide
  Seed: VLHQILKGGSGTYCLNVSLA (PMEL_HUMAN)
  Core: SGTYCLNVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGXGTXCXNVXLA

SEQ ID NO: 340029 - protein, 21 aa, Artificial Sequence
  Description of Artificial Sequence: Synthetic peptide
  Seed: VLHQILKGGSGTYCLNVSLAD (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNVSLAD

SEQ ID NO: 340030 - protein, 22 aa, Artificial Sequence
  Description of Artificial Sequence: Synthetic peptide
  Seed: VLHQILKGGSGTYCLNVSLADT (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNVSLADT

SEQ ID NO: 340031 - protein, 22 aa, Artificial Sequence
  Description of Artificial Sequence: Synthetic peptide
  Seed: VLHQILKGGSGTYCLNVSLADT (PMEL_HUMAN)
  Core: SGTYCLNVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGXGTXCXNVXLADT

SEQ ID NO: 340032 - protein, 22 aa, Artificial Sequence
  Description of Artificial Sequence: Synthetic peptide
  Seed: VLHQILKGGSGTYCLNVSLADT (PMEL_HUMAN)
  Core: YCLNVSLAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGSGTXCLXVXLAXT

SEQ ID NO: 340033 - protein, 23 aa, Artificial Sequence
  Description of Artificial Sequence: Synthetic peptide
  Seed: VLHQILKGGSGTYCLNVSLADTN (PMEL_HUMAN)
  Core: LHQILKGGS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHQXLXGGXGTYCLNVSLADTN

SEQ ID NO: 340034 - protein, 23 aa, Artificial Sequence
  Description of Artificial Sequence: Synthetic peptide
  Seed: VLHQILKGGSGTYCLNVSLADTN (PMEL_HUMAN)
  Core: SGTYCLNVS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGXGTXCXNVXLADTN

SEQ ID NO: 340035 - protein, 23 aa, Artificial Sequence
  Description of Artificial Sequence: Synthetic peptide
  Seed: VLHQILKGGSGTYCLNVSLADTN (PMEL_HUMAN)
  Core: YCLNVSLAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGSGTXCLXVXLAXTN

SEQ ID NO: 340036 - protein, 24 aa, Artificial Sequence
  Description of Artificial Sequence: Synthetic peptide
  Seed: VLHQILKGGSGTYCLNVSLADTNS (PMEL_HUMAN)
  Core: YCLNVSLAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGSGTXCLXVXLAXTNS

SEQ ID NO: 340037 - protein, 25 aa, Artificial Sequence
  Description of Artificial Sequence: Synthetic peptide
  Seed: VLHQILKGGSGTYCLNVSLADTNSL (PMEL_HUMAN)
  Core: LKGGSGTYC
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLHQIXKGXSXTYXLNVSLADTNSL

SEQ ID NO: 340038 - protein, 25 aa, Artificial Sequence
  Description of Artificial Sequence: Synthetic peptide
  Seed: VLHQILKGGSGTYCLNVSLADTNSL (PMEL_HUMAN)
  Core: TYCLNVSLA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGSGXYCXNXSLXDTNSL

SEQ ID NO: 340039 - protein, 25 aa, Artificial Sequence
  Description of Artificial Sequence: Synthetic peptide
  Seed: VLHQILKGGSGTYCLNVSLADTNSL (PMEL_HUMAN)
  Core: YCLNVSLAD
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VLHQILKGGSGTXCLXVXLAXTNSL

SEQ ID NO: 340040 - protein, 13 aa, Artificial Sequence
  Description of Artificial Sequence: Synthetic peptide
  Seed: VLKRCLLHLAVIG (PMEL_HUMAN)
  Core: LKRCLLHLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKRXLXHLXVIG

SEQ ID NO: 340041 - protein, 13 aa, Artificial Sequence
  Description of Artificial Sequence: Synthetic peptide
  Seed: VLKRCLLHLAVIG (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXG

SEQ ID NO: 340042 - protein, 14 aa, Artificial Sequence
  Description of Artificial Sequence: Synthetic peptide
  Seed: VLKRCLLHLAVIGA (PMEL_HUMAN)
  Core: LKRCLLHLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKRXLXHLXVIGA

SEQ ID NO: 340043 - protein, 14 aa, Artificial Sequence
  Description of Artificial Sequence: Synthetic peptide
  Seed: VLKRCLLHLAVIGA (PMEL_HUMAN)
  Core: KRCLLHLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRCXLXLAXIGA

SEQ ID NO: 340044 - protein, 14 aa, Artificial Sequence
  Description of Artificial Sequence: Synthetic peptide
  Seed: VLKRCLLHLAVIGA (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGA

SEQ ID NO: 340045 - protein, 14 aa, Artificial Sequence
  Description of Artificial Sequence: Synthetic peptide
  Seed: VLKRCLLHLAVIGA (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGX

SEQ ID NO: 340046 - protein, 15 aa, Artificial Sequence
  Description of Artificial Sequence: Synthetic peptide
  Seed: VLKRCLLHLAVIGAL (PMEL_HUMAN)
  Core: LKRCLLHLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKRXLXHLXVIGAL

SEQ ID NO: 340047 - protein, 15 aa, Artificial Sequence
  Description of Artificial Sequence: Synthetic peptide
  Seed: VLKRCLLHLAVIGAL (PMEL_HUMAN)
  Core: KRCLLHLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRCXLXLAXIGAL

SEQ ID NO: 340048 - protein, 15 aa, Artificial Sequence
  Description of Artificial Sequence: Synthetic peptide
  Seed: VLKRCLLHLAVIGAL (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGAL

SEQ ID NO: 340049 - protein, 15 aa, Artificial Sequence
  Description of Artificial Sequence: Synthetic peptide
  Seed: VLKRCLLHLAVIGAL (PMEL_HUMAN)
  Core: CLLHLAVIG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLKRXLLXLXVIXAL

SEQ ID NO: 340050 - protein, 15 aa, Artificial Sequence
  Description of Artificial Sequence: Synthetic peptide
  Seed: VLKRCLLHLAVIGAL (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXL

SEQ ID NO: 340051 - protein, 15 aa, Artificial Sequence
  Description of Artificial Sequence: Synthetic peptide
  Seed: VLKRCLLHLAVIGAL (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAX

SEQ ID NO: 340052 - protein, 16 aa, Artificial Sequence
  Description of Artificial Sequence: Synthetic peptide
  Seed: VLKRCLLHLAVIGALL (PMEL_HUMAN)
  Core: LKRCLLHLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKRXLXHLXVIGALL

SEQ ID NO: 340053 - protein, 16 aa, Artificial Sequence
  Description of Artificial Sequence: Synthetic peptide
  Seed: VLKRCLLHLAVIGALL (PMEL_HUMAN)
  Core: KRCLLHLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRCXLXLAXIGALL

SEQ ID NO: 340054 - protein, 16 aa, Artificial Sequence
  Description of Artificial Sequence: Synthetic peptide
  Seed: VLKRCLLHLAVIGALL (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALL

SEQ ID NO: 340055 - protein, 16 aa, Artificial Sequence
  Description of Artificial Sequence: Synthetic peptide
  Seed: VLKRCLLHLAVIGALL (PMEL_HUMAN)
  Core: CLLHLAVIG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLKRXLLXLXVIXALL

SEQ ID NO: 340056 - protein, 16 aa, Artificial Sequence
  Description of Artificial Sequence: Synthetic peptide
  Seed: VLKRCLLHLAVIGALL (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXLL

SEQ ID NO: 340057 - protein, 16 aa, Artificial Sequence
  Description of Artificial Sequence: Synthetic peptide
  Seed: VLKRCLLHLAVIGALL (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAXL

SEQ ID NO: 340058 - protein, 17 aa, Artificial Sequence
  Description of Artificial Sequence: Synthetic peptide
  Seed: VLKRCLLHLAVIGALLA (PMEL_HUMAN)
  Core: KRCLLHLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRCXLXLAXIGALLA

SEQ ID NO: 340059 - protein, 17 aa, Artificial Sequence
  Description of Artificial Sequence: Synthetic peptide
  Seed: VLKRCLLHLAVIGALLA (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALLA

SEQ ID NO: 340060 - protein, 17 aa, Artificial Sequence
  Description of Artificial Sequence: Synthetic peptide
  Seed: VLKRCLLHLAVIGALLA (PMEL_HUMAN)
  Core: CLLHLAVIG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLKRXLLXLXVIXALLA

SEQ ID NO: 340061 - protein, 17 aa, Artificial Sequence
  Description of Artificial Sequence: Synthetic peptide
  Seed: VLKRCLLHLAVIGALLA (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXLLA

SEQ ID NO: 340062 - protein, 17 aa, Artificial Sequence
  Description of Artificial Sequence: Synthetic peptide
  Seed: VLKRCLLHLAVIGALLA (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAXLA

SEQ ID NO: 340063 - protein, 17 aa, Artificial Sequence
  Description of Artificial Sequence: Synthetic peptide
  Seed: VLKRCLLHLAVIGALLA (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLX

SEQ ID NO: 340064 - protein, 18 aa, Artificial Sequence
  Description of Artificial Sequence: Synthetic peptide
  Seed: VLKRCLLHLAVIGALLAV (PMEL_HUMAN)
  Core: LKRCLLHLA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXKRXLXHLXVIGALLAV

SEQ ID NO: 340065 - protein, 18 aa, Artificial Sequence
  Description of Artificial Sequence: Synthetic peptide
  Seed: VLKRCLLHLAVIGALLAV (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALLAV

SEQ ID NO: 340066 - protein, 18 aa, Artificial Sequence
  Description of Artificial Sequence: Synthetic peptide
  Seed: VLKRCLLHLAVIGALLAV (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXLLAV

SEQ ID NO: 340067 - protein, 18 aa, Artificial Sequence
  Description of Artificial Sequence: Synthetic peptide
  Seed: VLKRCLLHLAVIGALLAV (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAXLAV

SEQ ID NO: 340068 - protein, 18 aa, Artificial Sequence
  Description of Artificial Sequence: Synthetic peptide
  Seed: VLKRCLLHLAVIGALLAV (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXV

SEQ ID NO: 340069 - protein, 19 aa, Artificial Sequence
  Description of Artificial Sequence: Synthetic peptide
  Seed: VLKRCLLHLAVIGALLAVG (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALLAVG

SEQ ID NO: 340070 - protein, 19 aa, Artificial Sequence
  Description of Artificial Sequence: Synthetic peptide
  Seed: VLKRCLLHLAVIGALLAVG (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXLLAVG

SEQ ID NO: 340071 - protein, 19 aa, Artificial Sequence
  Description of Artificial Sequence: Synthetic peptide
  Seed: VLKRCLLHLAVIGALLAVG (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAXLAVG

SEQ ID NO: 340072 - protein, 19 aa, Artificial Sequence
  Description of Artificial Sequence: Synthetic peptide
  Seed: VLKRCLLHLAVIGALLAVG (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVG

SEQ ID NO: 340073 - protein, 19 aa, Artificial Sequence
  Description of Artificial Sequence: Synthetic peptide
  Seed: VLKRCLLHLAVIGALLAVG (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVX

SEQ ID NO: 340074 - protein, 20 aa, Artificial Sequence
  Description of Artificial Sequence: Synthetic peptide
  Seed: VLKRCLLHLAVIGALLAVGA (PMEL_HUMAN)
  Core: KRCLLHLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRCXLXLAXIGALLAVGA

SEQ ID NO: 340075 - protein, 20 aa, Artificial Sequence
  Description of Artificial Sequence: Synthetic peptide
  Seed: VLKRCLLHLAVIGALLAVGA (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALLAVGA

SEQ ID NO: 340076 - protein, 20 aa, Artificial Sequence
  Description of Artificial Sequence: Synthetic peptide
  Seed: VLKRCLLHLAVIGALLAVGA (PMEL_HUMAN)
  Core: LLHLAVIGA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCXLHXAXIGXLLAVGA

SEQ ID NO: 340077 - protein, 20 aa, Artificial Sequence
  Description of Artificial Sequence: Synthetic peptide
  Seed: VLKRCLLHLAVIGALLAVGA (PMEL_HUMAN)
  Core: LHLAVIGAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLXHLXVXGAXLAVGA

SEQ ID NO: 340078 - protein, 20 aa, Artificial Sequence
  Description of Artificial Sequence: Synthetic peptide
  Seed: VLKRCLLHLAVIGALLAVGA (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVGA

SEQ ID NO: 340079 - protein, 20 aa, Artificial Sequence
  Description of Artificial Sequence: Synthetic peptide
  Seed: VLKRCLLHLAVIGALLAVGA (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXA

SEQ ID NO: 340080 - protein, 21 aa, Artificial Sequence
  Description of Artificial Sequence: Synthetic peptide
  Seed: VLKRCLLHLAVIGALLAVGAT (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVGAT

SEQ ID NO: 340081 - protein, 21 aa, Artificial Sequence
  Description of Artificial Sequence: Synthetic peptide
  Seed: VLKRCLLHLAVIGALLAVGAT (PMEL_HUMAN)
  Core: AVIGALLAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLXVIXAXLAXGAT

SEQ ID NO: 340082 - protein, 21 aa, Artificial Sequence
  Description of Artificial Sequence: Synthetic peptide
  Seed: VLKRCLLHLAVIGALLAVGAT (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXAT

SEQ ID NO: 340083 - protein, 21 aa, Artificial Sequence
  Description of Artificial Sequence: Synthetic peptide
  Seed: VLKRCLLHLAVIGALLAVGAT (PMEL_HUMAN)
  Core: IGALLAVGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVXGAXLXVGXT

SEQ ID NO: 340084 - protein, 22 aa, Artificial Sequence
  Description of Artificial Sequence: Synthetic peptide
  Seed: VLKRCLLHLAVIGALLAVGATK (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVGATK

SEQ ID NO: 340085 - protein, 22 aa, Artificial Sequence
  Description of Artificial Sequence: Synthetic peptide
  Seed: VLKRCLLHLAVIGALLAVGATK (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXATK

SEQ ID NO: 340086 - protein, 22 aa, Artificial Sequence
  Description of Artificial Sequence: Synthetic peptide
  Seed: VLKRCLLHLAVIGALLAVGATK (PMEL_HUMAN)
  Core: IGALLAVGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVXGAXLXVGXTK

SEQ ID NO: 340087 - protein, 23 aa, Artificial Sequence
  Description of Artificial Sequence: Synthetic peptide
  Seed: VLKRCLLHLAVIGALLAVGATKV (PMEL_HUMAN)
  Core: RCLLHLAVI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLKXCLXHXAVXGALLAVGATKV

SEQ ID NO: 340088 - protein, 23 aa, Artificial Sequence
  Description of Artificial Sequence: Synthetic peptide
  Seed: VLKRCLLHLAVIGALLAVGATKV (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVGATKV

SEQ ID NO: 340089 - protein, 23 aa, Artificial Sequence
  Description of Artificial Sequence: Synthetic peptide
  Seed: VLKRCLLHLAVIGALLAVGATKV (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXATKV

SEQ ID NO: 340090 - protein, 23 aa, Artificial Sequence
  Description of Artificial Sequence: Synthetic peptide
  Seed: VLKRCLLHLAVIGALLAVGATKV (PMEL_HUMAN)
  Core: IGALLAVGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVXGAXLXVGXTKV

SEQ ID NO: 340091 - protein, 23 aa, Artificial Sequence
  Description of Artificial Sequence: Synthetic peptide
  Seed: VLKRCLLHLAVIGALLAVGATKV (PMEL_HUMAN)
  Core: LLAVGATKV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVIGAXLAXGXTKX

SEQ ID NO: 340092 - protein, 24 aa, Artificial Sequence
  Description of Artificial Sequence: Synthetic peptide
  Seed: VLKRCLLHLAVIGALLAVGATKVP (PMEL_HUMAN)
  Core: LAVIGALLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHXAVXGXLLXVGATKVP

SEQ ID NO: 340093 - protein, 24 aa, Artificial Sequence
  Description of Artificial Sequence: Synthetic peptide
  Seed: VLKRCLLHLAVIGALLAVGATKVP (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXATKVP

SEQ ID NO: 340094 - protein, 24 aa, Artificial Sequence
  Description of Artificial Sequence: Synthetic peptide
  Seed: VLKRCLLHLAVIGALLAVGATKVP (PMEL_HUMAN)
  Core: IGALLAVGA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVXGAXLXVGXTKVP

SEQ ID NO: 340095 - protein, 24 aa, Artificial Sequence
  Description of Artificial Sequence: Synthetic peptide
  Seed: VLKRCLLHLAVIGALLAVGATKVP (PMEL_HUMAN)
  Core: LLAVGATKV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVIGAXLAXGXTKXP

SEQ ID NO: 340096 - protein, 25 aa, Artificial Sequence
  Description of Artificial Sequence: Synthetic peptide
  Seed: VLKRCLLHLAVIGALLAVGATKVPR (PMEL_HUMAN)
  Core: VIGALLAVG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAXIGXLXAVXATKVPR

SEQ ID NO: 340097 - protein, 25 aa, Artificial Sequence
  Description of Artificial Sequence: Synthetic peptide
  Seed: VLKRCLLHLAVIGALLAVGATKVPR (PMEL_HUMAN)
  Core: LLAVGATKV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLKRCLLHLAVIGAXLAXGXTKXPR

SEQ ID NO: 340098 - protein, 13 aa, Artificial Sequence
  Description of Artificial Sequence: Synthetic peptide
  Seed: VLMAVVLASLIYR (PMEL_HUMAN)
  Core: LMAVVLASL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXMAXVXASXIYR

SEQ ID NO: 340099 - protein, 13 aa, Artificial Sequence
  Description of Artificial Sequence: Synthetic peptide
  Seed: VLMAVVLASLIYR (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYR

SEQ ID NO: 340100 - protein, 14 aa, Artificial Sequence
  Description of Artificial Sequence: Synthetic peptide
  Seed: VLMAVVLASLIYRR (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRR

SEQ ID NO: 340101 - protein, 14 aa, Artificial Sequence
  Description of Artificial Sequence: Synthetic peptide
  Seed: VLMAVVLASLIYRR (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXR

SEQ ID NO: 340102 - protein, 14 aa, Artificial Sequence
  Description of Artificial Sequence: Synthetic peptide
  Seed: VLMAVVLASLIYRR (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRX

SEQ ID NO: 340103 - protein, 15 aa, Artificial Sequence
  Description of Artificial Sequence: Synthetic peptide
  Seed: VLMAVVLASLIYRRR (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRR

SEQ ID NO: 340104 - protein, 15 aa, Artificial Sequence
  Description of Artificial Sequence: Synthetic peptide
  Seed: VLMAVVLASLIYRRR (PMEL_HUMAN)
  Core: AVVLASLIY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLMXVVXAXLIXRRR

SEQ ID NO: 340105 - protein, 15 aa, Artificial Sequence
  Description of Artificial Sequence: Synthetic peptide
  Seed: VLMAVVLASLIYRRR (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXRR

SEQ ID NO: 340106 - protein, 15 aa, Artificial Sequence
  Description of Artificial Sequence: Synthetic peptide
  Seed: VLMAVVLASLIYRRR (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXR

SEQ ID NO: 340107 - protein, 15 aa, Artificial Sequence
  Description of Artificial Sequence: Synthetic peptide
  Seed: VLMAVVLASLIYRRR (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRX

SEQ ID NO: 340108 - protein, 16 aa, Artificial Sequence
  Description of Artificial Sequence: Synthetic peptide
  Seed: VLMAVVLASLIYRRRL (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRL

SEQ ID NO: 340109 - protein, 16 aa, Artificial Sequence
  Description of Artificial Sequence: Synthetic peptide
  Seed: VLMAVVLASLIYRRRL (PMEL_HUMAN)
  Core: AVVLASLIY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLMXVVXAXLIXRRRL

SEQ ID NO: 340110 - protein, 16 aa, Artificial Sequence
  Description of Artificial Sequence: Synthetic peptide
  Seed: VLMAVVLASLIYRRRL (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXRRL

SEQ ID NO: 340111 - protein, 16 aa, Artificial Sequence
  Description of Artificial Sequence: Synthetic peptide
  Seed: VLMAVVLASLIYRRRL (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRL

SEQ ID NO: 340112 - protein, 16 aa, Artificial Sequence
  Description of Artificial Sequence: Synthetic peptide
  Seed: VLMAVVLASLIYRRRL (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXL

SEQ ID NO: 340113 - protein, 17 aa, Artificial Sequence
  Description of Artificial Sequence: Synthetic peptide
  Seed: VLMAVVLASLIYRRRLM (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLM

SEQ ID NO: 340114 - protein, 17 aa, Artificial Sequence
  Description of Artificial Sequence: Synthetic peptide
  Seed: VLMAVVLASLIYRRRLM (PMEL_HUMAN)
  Core: AVVLASLIY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLMXVVXAXLIXRRRLM

SEQ ID NO: 340115 - protein, 17 aa, Artificial Sequence
  Description of Artificial Sequence: Synthetic peptide
  Seed: VLMAVVLASLIYRRRLM (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXRRLM

SEQ ID NO: 340116 - protein, 17 aa, Artificial Sequence
  Description of Artificial Sequence: Synthetic peptide
  Seed: VLMAVVLASLIYRRRLM (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLM

SEQ ID NO: 340117 - protein, 17 aa, Artificial Sequence
  Description of Artificial Sequence: Synthetic peptide
  Seed: VLMAVVLASLIYRRRLM (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLM

SEQ ID NO: 340118 - protein, 18 aa, Artificial Sequence
  Description of Artificial Sequence: Synthetic peptide
  Seed: VLMAVVLASLIYRRRLMK (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMK

SEQ ID NO: 340119 - protein, 18 aa, Artificial Sequence
  Description of Artificial Sequence: Synthetic peptide
  Seed: VLMAVVLASLIYRRRLMK (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMK

SEQ ID NO: 340120 - protein, 18 aa, Artificial Sequence
  Description of Artificial Sequence: Synthetic peptide
  Seed: VLMAVVLASLIYRRRLMK (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMK

SEQ ID NO: 340121 - protein, 18 aa, Artificial Sequence
  Description of Artificial Sequence: Synthetic peptide
  Seed: VLMAVVLASLIYRRRLMK (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMK

SEQ ID NO: 340122 - protein, 19 aa, Artificial Sequence
  Description of Artificial Sequence: Synthetic peptide
  Seed: VLMAVVLASLIYRRRLMKQ (PMEL_HUMAN)
  Core: AVVLASLIY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLMXVVXAXLIXRRRLMKQ

SEQ ID NO: 340123 - protein, 19 aa, Artificial Sequence
  Description of Artificial Sequence: Synthetic peptide
  Seed: VLMAVVLASLIYRRRLMKQ (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQ

SEQ ID NO: 340124 - protein, 19 aa, Artificial Sequence
  Description of Artificial Sequence: Synthetic peptide
  Seed: VLMAVVLASLIYRRRLMKQ (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQ

SEQ ID NO: 340125 - protein, 19 aa, Artificial Sequence
  Description of Artificial Sequence: Synthetic peptide
  Seed: VLMAVVLASLIYRRRLMKQ (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQ

SEQ ID NO: 340126 - protein, 19 aa, Artificial Sequence
  Description of Artificial Sequence: Synthetic peptide
  Seed: VLMAVVLASLIYRRRLMKQ (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQ

SEQ ID NO: 340127 - protein, 19 aa, Artificial Sequence
  Description of Artificial Sequence: Synthetic peptide
  Seed: VLMAVVLASLIYRRRLMKQ (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQ

SEQ ID NO: 340128 - protein, 20 aa, Artificial Sequence
  Description of Artificial Sequence: Synthetic peptide
  Seed: VLMAVVLASLIYRRRLMKQD (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXRRLMKQD

SEQ ID NO: 340129 - protein, 20 aa, Artificial Sequence
  Description of Artificial Sequence: Synthetic peptide
  Seed: VLMAVVLASLIYRRRLMKQD (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQD

SEQ ID NO: 340130 - protein, 20 aa, Artificial Sequence
  Description of Artificial Sequence: Synthetic peptide
  Seed: VLMAVVLASLIYRRRLMKQD (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQD

SEQ ID NO: 340131 - protein, 20 aa, Artificial Sequence
  Description of Artificial Sequence: Synthetic peptide
  Seed: VLMAVVLASLIYRRRLMKQD (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQD

SEQ ID NO: 340132 - protein, 20 aa, Artificial Sequence
  Description of Artificial Sequence: Synthetic peptide
  Seed: VLMAVVLASLIYRRRLMKQD (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQD

SEQ ID NO: 340133 - protein, 20 aa, Artificial Sequence
  Description of Artificial Sequence: Synthetic peptide
  Seed: VLMAVVLASLIYRRRLMKQD (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQD

SEQ ID NO: 340134 - protein, 20 aa, Artificial Sequence
  Description of Artificial Sequence: Synthetic peptide
  Seed: VLMAVVLASLIYRRRLMKQD (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXD

SEQ ID NO: 340135 - protein, 21 aa, Artificial Sequence
  Description of Artificial Sequence: Synthetic peptide
  Seed: VLMAVVLASLIYRRRLMKQDF (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMKQDF

SEQ ID NO: 340136 - protein, 21 aa, Artificial Sequence
  Description of Artificial Sequence: Synthetic peptide
  Seed: VLMAVVLASLIYRRRLMKQDF (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQDF

SEQ ID NO: 340137 - protein, 21 aa, Artificial Sequence
  Description of Artificial Sequence: Synthetic peptide
  Seed: VLMAVVLASLIYRRRLMKQDF (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQDF

SEQ ID NO: 340138 - protein, 21 aa, Artificial Sequence
  Description of Artificial Sequence: Synthetic peptide
  Seed: VLMAVVLASLIYRRRLMKQDF (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQDF

SEQ ID NO: 340139 - protein, 21 aa, Artificial Sequence
  Description of Artificial Sequence: Synthetic peptide
  Seed: VLMAVVLASLIYRRRLMKQDF (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQDF

SEQ ID NO: 340140 - protein, 21 aa, Artificial Sequence
  Description of Artificial Sequence: Synthetic peptide
  Seed: VLMAVVLASLIYRRRLMKQDF (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQDF

SEQ ID NO: 340141 - protein, 21 aa, Artificial Sequence
  Description of Artificial Sequence: Synthetic peptide
  Seed: VLMAVVLASLIYRRRLMKQDF (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXDF

SEQ ID NO: 340142 - protein, 21 aa, Artificial Sequence
  Description of Artificial Sequence: Synthetic peptide
  Seed: VLMAVVLASLIYRRRLMKQDF (PMEL_HUMAN)
  Core: YRRRLMKQD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIXRRXLXKQXF

SEQ ID NO: 340143 - protein, 22 aa, Artificial Sequence
  Description of Artificial Sequence: Synthetic peptide
  Seed: VLMAVVLASLIYRRRLMKQDFS (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMKQDFS

SEQ ID NO: 340144 - protein, 22 aa, Artificial Sequence
  Description of Artificial Sequence: Synthetic peptide
  Seed: VLMAVVLASLIYRRRLMKQDFS (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQDFS

SEQ ID NO: 340145 - protein, 22 aa, Artificial Sequence
  Description of Artificial Sequence: Synthetic peptide
  Seed: VLMAVVLASLIYRRRLMKQDFS (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQDFS

SEQ ID NO: 340146 - protein, 22 aa, Artificial Sequence
  Description of Artificial Sequence: Synthetic peptide
  Seed: VLMAVVLASLIYRRRLMKQDFS (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQDFS

SEQ ID NO: 340147 - protein, 22 aa, Artificial Sequence
  Description of Artificial Sequence: Synthetic peptide
  Seed: VLMAVVLASLIYRRRLMKQDFS (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQDFS

SEQ ID NO: 340148 - protein, 22 aa, Artificial Sequence
  Description of Artificial Sequence: Synthetic peptide
  Seed: VLMAVVLASLIYRRRLMKQDFS (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQDFS

SEQ ID NO: 340149 - protein, 22 aa, Artificial Sequence
  Description of Artificial Sequence: Synthetic peptide
  Seed: VLMAVVLASLIYRRRLMKQDFS (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXDFS

SEQ ID NO: 340150 - protein, 22 aa, Artificial Sequence
  Description of Artificial Sequence: Synthetic peptide
  Seed: VLMAVVLASLIYRRRLMKQDFS (PMEL_HUMAN)
  Core: YRRRLMKQD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIXRRXLXKQXFS

SEQ ID NO: 340151 - protein, 23 aa, Artificial Sequence
  Description of Artificial Sequence: Synthetic peptide
  Seed: VLMAVVLASLIYRRRLMKQDFSV (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMKQDFSV

SEQ ID NO: 340152 - protein, 23 aa, Artificial Sequence
  Description of Artificial Sequence: Synthetic peptide
  Seed: VLMAVVLASLIYRRRLMKQDFSV (PMEL_HUMAN)
  Core: VVLASLIYR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLMAXVLXSXIYXRRLMKQDFSV

SEQ ID NO: 340153 - protein, 23 aa, Artificial Sequence
  Description of Artificial Sequence: Synthetic peptide
  Seed: VLMAVVLASLIYRRRLMKQDFSV (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQDFSV

SEQ ID NO: 340154 - protein, 23 aa, Artificial Sequence
  Description of Artificial Sequence: Synthetic peptide
  Seed: VLMAVVLASLIYRRRLMKQDFSV (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQDFSV

SEQ ID NO: 340155 - protein, 23 aa, Artificial Sequence
  Description of Artificial Sequence: Synthetic peptide
  Seed: VLMAVVLASLIYRRRLMKQDFSV (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQDFSV

SEQ ID NO: 340156 - protein, 23 aa, Artificial Sequence
  Description of Artificial Sequence: Synthetic peptide
  Seed: VLMAVVLASLIYRRRLMKQDFSV (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQDFSV

SEQ ID NO: 340157 - protein, 23 aa, Artificial Sequence
  Description of Artificial Sequence: Synthetic peptide
  Seed: VLMAVVLASLIYRRRLMKQDFSV (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQDFSV

SEQ ID NO: 340158 - protein, 23 aa, Artificial Sequence
  Description of Artificial Sequence: Synthetic peptide
  Seed: VLMAVVLASLIYRRRLMKQDFSV (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXDFSV

SEQ ID NO: 340159 - protein, 23 aa, Artificial Sequence
  Description of Artificial Sequence: Synthetic peptide
  Seed: VLMAVVLASLIYRRRLMKQDFSV (PMEL_HUMAN)
  Core: YRRRLMKQD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIXRRXLXKQXFSV

SEQ ID NO: 340160 - protein, 23 aa, Artificial Sequence
  Description of Artificial Sequence: Synthetic peptide
  Seed: VLMAVVLASLIYRRRLMKQDFSV (PMEL_HUMAN)
  Core: RRLMKQDFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIYRXRLXKXDFXV

SEQ ID NO: 340161 - protein, 24 aa, Artificial Sequence
  Description of Artificial Sequence: Synthetic peptide
  Seed: VLMAVVLASLIYRRRLMKQDFSVP (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMKQDFSVP

SEQ ID NO: 340162 - protein, 24 aa, Artificial Sequence
  Description of Artificial Sequence: Synthetic peptide
  Seed: VLMAVVLASLIYRRRLMKQDFSVP (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQDFSVP

SEQ ID NO: 340163 - protein, 24 aa, Artificial Sequence
  Description of Artificial Sequence: Synthetic peptide
  Seed: VLMAVVLASLIYRRRLMKQDFSVP (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQDFSVP

SEQ ID NO: 340164 - protein, 24 aa, Artificial Sequence
  Description of Artificial Sequence: Synthetic peptide
  Seed: VLMAVVLASLIYRRRLMKQDFSVP (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQDFSVP

SEQ ID NO: 340165 - protein, 24 aa, Artificial Sequence
  Description of Artificial Sequence: Synthetic peptide
  Seed: VLMAVVLASLIYRRRLMKQDFSVP (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQDFSVP

SEQ ID NO: 340166 - protein, 24 aa, Artificial Sequence
  Description of Artificial Sequence: Synthetic peptide
  Seed: VLMAVVLASLIYRRRLMKQDFSVP (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQDFSVP

SEQ ID NO: 340167 - protein, 24 aa, Artificial Sequence
  Description of Artificial Sequence: Synthetic peptide
  Seed: VLMAVVLASLIYRRRLMKQDFSVP (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXDFSVP

SEQ ID NO: 340168 - protein, 24 aa, Artificial Sequence
  Description of Artificial Sequence: Synthetic peptide
  Seed: VLMAVVLASLIYRRRLMKQDFSVP (PMEL_HUMAN)
  Core: YRRRLMKQD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIXRRXLXKQXFSVP

SEQ ID NO: 340169 - protein, 24 aa, Artificial Sequence
  Description of Artificial Sequence: Synthetic peptide
  Seed: VLMAVVLASLIYRRRLMKQDFSVP (PMEL_HUMAN)
  Core: RRLMKQDFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIYRXRLXKXDFXVP

SEQ ID NO: 340170 - protein, 25 aa, Artificial Sequence
  Description of Artificial Sequence: Synthetic peptide
  Seed: VLMAVVLASLIYRRRLMKQDFSVPQ (PMEL_HUMAN)
  Core: MAVVLASLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXAVXLXSLXYRRRLMKQDFSVPQ

SEQ ID NO: 340171 - protein, 25 aa, Artificial Sequence
  Description of Artificial Sequence: Synthetic peptide
  Seed: VLMAVVLASLIYRRRLMKQDFSVPQ (PMEL_HUMAN)
  Core: VLASLIYRR
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVXLAXLXYRXRLMKQDFSVPQ

SEQ ID NO: 340172 - protein, 25 aa, Artificial Sequence
  Description of Artificial Sequence: Synthetic peptide
  Seed: VLMAVVLASLIYRRRLMKQDFSVPQ (PMEL_HUMAN)
  Core: LASLIYRRR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVXASXIXRRXLMKQDFSVPQ

SEQ ID NO: 340173 - protein, 25 aa, Artificial Sequence
  Description of Artificial Sequence: Synthetic peptide
  Seed: VLMAVVLASLIYRRRLMKQDFSVPQ (PMEL_HUMAN)
  Core: ASLIYRRRL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLXSLXYXRRXMKQDFSVPQ

SEQ ID NO: 340174 - protein, 25 aa, Artificial Sequence
  Description of Artificial Sequence: Synthetic peptide
  Seed: VLMAVVLASLIYRRRLMKQDFSVPQ (PMEL_HUMAN)
  Core: SLIYRRRLM
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLAXLIXRXRLXKQDFSVPQ

SEQ ID NO: 340175 - protein, 25 aa, Artificial Sequence
  Description of Artificial Sequence: Synthetic peptide
  Seed: VLMAVVLASLIYRRRLMKQDFSVPQ (PMEL_HUMAN)
  Core: LIYRRRLMK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASXIYXRXLMXQDFSVPQ

SEQ ID NO: 340176 - protein, 25 aa, Artificial Sequence
  Description of Artificial Sequence: Synthetic peptide
  Seed: VLMAVVLASLIYRRRLMKQDFSVPQ (PMEL_HUMAN)
  Core: IYRRRLMKQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLXYRXRXMKXDFSVPQ

SEQ ID NO: 340177 - protein, 25 aa, Artificial Sequence
  Description of Artificial Sequence: Synthetic peptide
  Seed: VLMAVVLASLIYRRRLMKQDFSVPQ (PMEL_HUMAN)
  Core: YRRRLMKQD
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIXRRXLXKQXFSVPQ

SEQ ID NO: 340178 - protein, 25 aa, Artificial Sequence
  Description of Artificial Sequence: Synthetic peptide
  Seed: VLMAVVLASLIYRRRLMKQDFSVPQ (PMEL_HUMAN)
  Core: RRLMKQDFS
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIYRXRLXKXDFXVPQ

SEQ ID NO: 340179 - protein, 25 aa, Artificial Sequence
  Description of Artificial Sequence: Synthetic peptide
  Seed: VLMAVVLASLIYRRRLMKQDFSVPQ (PMEL_HUMAN)
  Core: RLMKQDFSV
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLMAVVLASLIYRRXLMXQXFSXPQ

SEQ ID NO: 340180 - protein, 14 aa, Artificial Sequence
  Description of Artificial Sequence: Synthetic peptide
  Seed: VLPDGQVIWVNNTI (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTX

SEQ ID NO: 340181 - protein, 15 aa, Artificial Sequence
  Description of Artificial Sequence: Synthetic peptide
  Seed: VLPDGQVIWVNNTII (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXI

SEQ ID NO: 340182 - protein, 15 aa, Artificial Sequence
  Description of Artificial Sequence: Synthetic peptide
  Seed: VLPDGQVIWVNNTII (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIX

SEQ ID NO: 340183 - protein, 16 aa, Artificial Sequence
  Description of Artificial Sequence: Synthetic peptide
  Seed: VLPDGQVIWVNNTIIN (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXIN

SEQ ID NO: 340184 - protein, 16 aa, Artificial Sequence
  Description of Artificial Sequence: Synthetic peptide
  Seed: VLPDGQVIWVNNTIIN (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXN

SEQ ID NO: 340185 - protein, 16 aa, Artificial Sequence
  Description of Artificial Sequence: Synthetic peptide
  Seed: VLPDGQVIWVNNTIIN (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIX

SEQ ID NO: 340186 - protein, 17 aa, Artificial Sequence
  Description of Artificial Sequence: Synthetic peptide
  Seed: VLPDGQVIWVNNTIING (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXING

SEQ ID NO: 340187 - protein, 17 aa, Artificial Sequence
  Description of Artificial Sequence: Synthetic peptide
  Seed: VLPDGQVIWVNNTIING (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNG

SEQ ID NO: 340188 - protein, 17 aa, Artificial Sequence
  Description of Artificial Sequence: Synthetic peptide
  Seed: VLPDGQVIWVNNTIING (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXG

SEQ ID NO: 340189 - protein, 18 aa, Artificial Sequence
  Description of Artificial Sequence: Synthetic peptide
  Seed: VLPDGQVIWVNNTIINGS (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGS

SEQ ID NO: 340190 - protein, 18 aa, Artificial Sequence
  Description of Artificial Sequence: Synthetic peptide
  Seed: VLPDGQVIWVNNTIINGS (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGS

SEQ ID NO: 340191 - protein, 18 aa, Artificial Sequence
  Description of Artificial Sequence: Synthetic peptide
  Seed: VLPDGQVIWVNNTIINGS (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGS

SEQ ID NO: 340192 - protein, 19 aa, Artificial Sequence
  Description of Artificial Sequence: Synthetic peptide
  Seed: VLPDGQVIWVNNTIINGSQ (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQ

SEQ ID NO: 340193 - protein, 19 aa, Artificial Sequence
  Description of Artificial Sequence: Synthetic peptide
  Seed: VLPDGQVIWVNNTIINGSQ (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQ

SEQ ID NO: 340194 - protein, 19 aa, Artificial Sequence
  Description of Artificial Sequence: Synthetic peptide
  Seed: VLPDGQVIWVNNTIINGSQ (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQ

SEQ ID NO: 340195 - protein, 20 aa, Artificial Sequence
  Description of Artificial Sequence: Synthetic peptide
  Seed: VLPDGQVIWVNNTIINGSQV (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQV

SEQ ID NO: 340196 - protein, 20 aa, Artificial Sequence
  Description of Artificial Sequence: Synthetic peptide
  Seed: VLPDGQVIWVNNTIINGSQV (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQV

SEQ ID NO: 340197 - protein, 20 aa, Artificial Sequence
  Description of Artificial Sequence: Synthetic peptide
  Seed: VLPDGQVIWVNNTIINGSQV (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQV

SEQ ID NO: 340198 - protein, 20 aa, Artificial Sequence
  Description of Artificial Sequence: Synthetic peptide
  Seed: VLPDGQVIWVNNTIINGSQV (PMEL_HUMAN)
  Core: VNNTIINGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWXNNXIXNGXQV

SEQ ID NO: 340199 - protein, 21 aa, Artificial Sequence
  Description of Artificial Sequence: Synthetic peptide
  Seed: VLPDGQVIWVNNTIINGSQVW (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQVW

SEQ ID NO: 340200 - protein, 21 aa, Artificial Sequence
  Description of Artificial Sequence: Synthetic peptide
  Seed: VLPDGQVIWVNNTIINGSQVW (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQVW

SEQ ID NO: 340201 - protein, 21 aa, Artificial Sequence
  Description of Artificial Sequence: Synthetic peptide
  Seed: VLPDGQVIWVNNTIINGSQVW (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQVW

SEQ ID NO: 340202 - protein, 21 aa, Artificial Sequence
  Description of Artificial Sequence: Synthetic peptide
  Seed: VLPDGQVIWVNNTIINGSQVW (PMEL_HUMAN)
  Core: WVNNTIING
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIXVNXTXINXSQVW

SEQ ID NO: 340203 - protein, 21 aa, Artificial Sequence
  Description of Artificial Sequence: Synthetic peptide
  Seed: VLPDGQVIWVNNTIINGSQVW (PMEL_HUMAN)
  Core: VNNTIINGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWXNNXIXNGXQVW

SEQ ID NO: 340204 - protein, 22 aa, Artificial Sequence
  Description of Artificial Sequence: Synthetic peptide
  Seed: VLPDGQVIWVNNTIINGSQVWG (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQVWG

SEQ ID NO: 340205 - protein, 22 aa, Artificial Sequence
  Description of Artificial Sequence: Synthetic peptide
  Seed: VLPDGQVIWVNNTIINGSQVWG (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQVWG

SEQ ID NO: 340206 - protein, 22 aa, Artificial Sequence
  Description of Artificial Sequence: Synthetic peptide
  Seed: VLPDGQVIWVNNTIINGSQVWG (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQVWG

SEQ ID NO: 340207 - protein, 22 aa, Artificial Sequence
  Description of Artificial Sequence: Synthetic peptide
  Seed: VLPDGQVIWVNNTIINGSQVWG (PMEL_HUMAN)
  Core: WVNNTIING
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIXVNXTXINXSQVWG

SEQ ID NO: 340208 - protein, 22 aa, Artificial Sequence
  Description of Artificial Sequence: Synthetic peptide
  Seed: VLPDGQVIWVNNTIINGSQVWG (PMEL_HUMAN)
  Core: VNNTIINGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWXNNXIXNGXQVWG

SEQ ID NO: 340209 - protein, 23 aa, Artificial Sequence
  Description of Artificial Sequence: Synthetic peptide
  Seed: VLPDGQVIWVNNTIINGSQVWGG (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQVWGG

SEQ ID NO: 340210 - protein, 23 aa, Artificial Sequence
  Description of Artificial Sequence: Synthetic peptide
  Seed: VLPDGQVIWVNNTIINGSQVWGG (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQVWGG

SEQ ID NO: 340211 - protein, 23 aa, Artificial Sequence
  Description of Artificial Sequence: Synthetic peptide
  Seed: VLPDGQVIWVNNTIINGSQVWGG (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQVWGG

SEQ ID NO: 340212 - protein, 23 aa, Artificial Sequence
  Description of Artificial Sequence: Synthetic peptide
  Seed: VLPDGQVIWVNNTIINGSQVWGG (PMEL_HUMAN)
  Core: VNNTIINGS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWXNNXIXNGXQVWGG

SEQ ID NO: 340213 - protein, 23 aa, Artificial Sequence
  Description of Artificial Sequence: Synthetic peptide
  Seed: VLPDGQVIWVNNTIINGSQVWGG (PMEL_HUMAN)
  Core: INGSQVWGG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWVNNTIXNGXQXWGX

SEQ ID NO: 340214 - protein, 24 aa, Artificial Sequence
  Description of Artificial Sequence: Synthetic peptide
  Seed: VLPDGQVIWVNNTIINGSQVWGGQ (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQVWGGQ

SEQ ID NO: 340215 - protein, 24 aa, Artificial Sequence
  Description of Artificial Sequence: Synthetic peptide
  Seed: VLPDGQVIWVNNTIINGSQVWGGQ (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQVWGGQ

SEQ ID NO: 340216 - protein, 24 aa, Artificial Sequence
  Description of Artificial Sequence: Synthetic peptide
  Seed: VLPDGQVIWVNNTIINGSQVWGGQ (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQVWGGQ

SEQ ID NO: 340217 - protein, 24 aa, Artificial Sequence
  Description of Artificial Sequence: Synthetic peptide
  Seed: VLPDGQVIWVNNTIINGSQVWGGQ (PMEL_HUMAN)
  Core: INGSQVWGG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWVNNTIXNGXQXWGXQ

SEQ ID NO: 340218 - protein, 25 aa, Artificial Sequence
  Description of Artificial Sequence: Synthetic peptide
  Seed: VLPDGQVIWVNNTIINGSQVWGGQP (PMEL_HUMAN)
  Core: QVIWVNNTI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGXVIXVXNTXINGSQVWGGQP

SEQ ID NO: 340219 - protein, 25 aa, Artificial Sequence
  Description of Artificial Sequence: Synthetic peptide
  Seed: VLPDGQVIWVNNTIINGSQVWGGQP (PMEL_HUMAN)
  Core: VIWVNNTII
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQXIWXNXTIXNGSQVWGGQP

SEQ ID NO: 340220 - protein, 25 aa, Artificial Sequence
  Description of Artificial Sequence: Synthetic peptide
  Seed: VLPDGQVIWVNNTIINGSQVWGGQP (PMEL_HUMAN)
  Core: IWVNNTIIN
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVXWVXNXIIXGSQVWGGQP

SEQ ID NO: 340221 - protein, 25 aa, Artificial Sequence
  Description of Artificial Sequence: Synthetic peptide
  Seed: VLPDGQVIWVNNTIINGSQVWGGQP (PMEL_HUMAN)
  Core: INGSQVWGG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLPDGQVIWVNNTIXNGXQXWGXQP

SEQ ID NO: 340222 - protein, 15 aa, Artificial Sequence
  Description of Artificial Sequence: Synthetic peptide
  Seed: VLPSPACQLVLHQIL (PMEL_HUMAN)
  Core: PACQLVLHQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLPSXACXLXLHXIL

SEQ ID NO: 340223 - protein, 15 aa, Artificial Sequence
  Description of Artificial Sequence: Synthetic peptide
  Seed: VLPSPACQLVLHQIL (PMEL_HUMAN)
  Core: ACQLVLHQI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPXCQXVXHQXL

SEQ ID NO: 340224 - protein, 15 aa, Artificial Sequence
  Description of Artificial Sequence: Synthetic peptide
  Seed: VLPSPACQLVLHQIL (PMEL_HUMAN)
  Core: CQLVLHQIL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPAXQLXLXQIX

SEQ ID NO: 340225 - protein, 16 aa, Artificial Sequence
  Description of Artificial Sequence: Synthetic peptide
  Seed: VLPSPACQLVLHQILK (PMEL_HUMAN)
  Core: PACQLVLHQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLPSXACXLXLHXILK

SEQ ID NO: 340226 - protein, 16 aa, Artificial Sequence
  Description of Artificial Sequence: Synthetic peptide
  Seed: VLPSPACQLVLHQILK (PMEL_HUMAN)
  Core: ACQLVLHQI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPXCQXVXHQXLK

SEQ ID NO: 340227 - protein, 16 aa, Artificial Sequence
  Description of Artificial Sequence: Synthetic peptide
  Seed: VLPSPACQLVLHQILK (PMEL_HUMAN)
  Core: CQLVLHQIL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPAXQLXLXQIXK

SEQ ID NO: 340228 - protein, 17 aa, Artificial Sequence
  Description of Artificial Sequence: Synthetic peptide
  Seed: VLPSPACQLVLHQILKG (PMEL_HUMAN)
  Core: PACQLVLHQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLPSXACXLXLHXILKG

SEQ ID NO: 340229 - protein, 17 aa, Artificial Sequence
  Description of Artificial Sequence: Synthetic peptide
  Seed: VLPSPACQLVLHQILKG (PMEL_HUMAN)
  Core: ACQLVLHQI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPXCQXVXHQXLKG

SEQ ID NO: 340230 - protein, 17 aa, Artificial Sequence
  Description of Artificial Sequence: Synthetic peptide
  Seed: VLPSPACQLVLHQILKG (PMEL_HUMAN)
  Core: CQLVLHQIL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPAXQLXLXQIXKG

SEQ ID NO: 340231 - protein, 17 aa, Artificial Sequence
  Description of Artificial Sequence: Synthetic peptide
  Seed: VLPSPACQLVLHQILKG (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKX

SEQ ID NO: 340232 - protein, 18 aa, Artificial Sequence
  Description of Artificial Sequence: Synthetic peptide
  Seed: VLPSPACQLVLHQILKGG (PMEL_HUMAN)
  Core: CQLVLHQIL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPAXQLXLXQIXKGG

SEQ ID NO: 340233 - protein, 18 aa, Artificial Sequence
  Description of Artificial Sequence: Synthetic peptide
  Seed: VLPSPACQLVLHQILKGG (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXG

SEQ ID NO: 340234 - protein, 19 aa, Artificial Sequence
  Description of Artificial Sequence: Synthetic peptide
  Seed: VLPSPACQLVLHQILKGGS (PMEL_HUMAN)
  Core: CQLVLHQIL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPAXQLXLXQIXKGGS

SEQ ID NO: 340235 - protein, 19 aa, Artificial Sequence
  Description of Artificial Sequence: Synthetic peptide
  Seed: VLPSPACQLVLHQILKGGS (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGS

SEQ ID NO: 340236 - protein, 20 aa, Artificial Sequence
  Description of Artificial Sequence: Synthetic peptide
  Seed: VLPSPACQLVLHQILKGGSG (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSG

SEQ ID NO: 340237 - protein, 20 aa, Artificial Sequence
  Description of Artificial Sequence: Synthetic peptide
  Seed: VLPSPACQLVLHQILKGGSG (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXG

SEQ ID NO: 340238 - protein, 21 aa, Artificial Sequence
  Description of Artificial Sequence: Synthetic peptide
  Seed: VLPSPACQLVLHQILKGGSGT (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSGT

SEQ ID NO: 340239 - protein, 21 aa, Artificial Sequence
  Description of Artificial Sequence: Synthetic peptide
  Seed: VLPSPACQLVLHQILKGGSGT (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXGT

SEQ ID NO: 340240 - protein, 22 aa, Artificial Sequence
  Description of Artificial Sequence: Synthetic peptide
  Seed: VLPSPACQLVLHQILKGGSGTY (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSGTY

SEQ ID NO: 340241 - protein, 22 aa, Artificial Sequence
  Description of Artificial Sequence: Synthetic peptide
  Seed: VLPSPACQLVLHQILKGGSGTY (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXGTY

SEQ ID NO: 340242 - protein, 23 aa, Artificial Sequence
  Description of Artificial Sequence: Synthetic peptide
  Seed: VLPSPACQLVLHQILKGGSGTYC (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSGTYC

SEQ ID NO: 340243 - protein, 23 aa, Artificial Sequence
  Description of Artificial Sequence: Synthetic peptide
  Seed: VLPSPACQLVLHQILKGGSGTYC (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXGTYC

SEQ ID NO: 340244 - protein, 24 aa, Artificial Sequence
  Description of Artificial Sequence: Synthetic peptide
  Seed: VLPSPACQLVLHQILKGGSGTYCL (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSGTYCL

SEQ ID NO: 340245 - protein, 24 aa, Artificial Sequence
  Description of Artificial Sequence: Synthetic peptide
  Seed: VLPSPACQLVLHQILKGGSGTYCL (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXGTYCL

SEQ ID NO: 340246 - protein, 25 aa, Artificial Sequence
  Description of Artificial Sequence: Synthetic peptide
  Seed: VLPSPACQLVLHQILKGGSGTYCLN (PMEL_HUMAN)
  Core: LVLHQILKG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQXVLXQXLKXGSGTYCLN

SEQ ID NO: 340247 - protein, 25 aa, Artificial Sequence
  Description of Artificial Sequence: Synthetic peptide
  Seed: VLPSPACQLVLHQILKGGSGTYCLN (PMEL_HUMAN)
  Core: LHQILKGGS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLPSPACQLVXHQXLXGGXGTYCLN

SEQ ID NO: 340248 - protein, 13 aa, Artificial Sequence
  Description of Artificial Sequence: Synthetic peptide
  Seed: VLQAAIPLTSCGS (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGS

SEQ ID NO: 340249 - protein, 14 aa, Artificial Sequence
  Description of Artificial Sequence: Synthetic peptide
  Seed: VLQAAIPLTSCGSS (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSS

SEQ ID NO: 340250 - protein, 15 aa, Artificial Sequence
  Description of Artificial Sequence: Synthetic peptide
  Seed: VLQAAIPLTSCGSSP (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSP

SEQ ID NO: 340251 - protein, 15 aa, Artificial Sequence
  Description of Artificial Sequence: Synthetic peptide
  Seed: VLQAAIPLTSCGSSP (PMEL_HUMAN)
  Core: AIPLTSCGS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLQAXIPXTXCGXSP

SEQ ID NO: 340252 - protein, 16 aa, Artificial Sequence
  Description of Artificial Sequence: Synthetic peptide
  Seed: VLQAAIPLTSCGSSPV (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPV

SEQ ID NO: 340253 - protein, 16 aa, Artificial Sequence
  Description of Artificial Sequence: Synthetic peptide
  Seed: VLQAAIPLTSCGSSPV (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPX

SEQ ID NO: 340254 - protein, 17 aa, Artificial Sequence
  Description of Artificial Sequence: Synthetic peptide
  Seed: VLQAAIPLTSCGSSPVP (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVP

SEQ ID NO: 340255 - protein, 17 aa, Artificial Sequence
  Description of Artificial Sequence: Synthetic peptide
  Seed: VLQAAIPLTSCGSSPVP (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXP

SEQ ID NO: 340256 - protein, 18 aa, Artificial Sequence
  Description of Artificial Sequence: Synthetic peptide
  Seed: VLQAAIPLTSCGSSPVPG (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPG

SEQ ID NO: 340257 - protein, 18 aa, Artificial Sequence
  Description of Artificial Sequence: Synthetic peptide
  Seed: VLQAAIPLTSCGSSPVPG (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPG

SEQ ID NO: 340258 - protein, 19 aa, Artificial Sequence
  Description of Artificial Sequence: Synthetic peptide
  Seed: VLQAAIPLTSCGSSPVPGT (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGT

SEQ ID NO: 340259 - protein, 19 aa, Artificial Sequence
  Description of Artificial Sequence: Synthetic peptide
  Seed: VLQAAIPLTSCGSSPVPGT (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGT

SEQ ID NO: 340260 - protein, 19 aa, Artificial Sequence
  Description of Artificial Sequence: Synthetic peptide
  Seed: VLQAAIPLTSCGSSPVPGT (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXT

SEQ ID NO: 340261 - protein, 20 aa, Artificial Sequence
  Description of Artificial Sequence: Synthetic peptide
  Seed: VLQAAIPLTSCGSSPVPGTT (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGTT

SEQ ID NO: 340262 - protein, 20 aa, Artificial Sequence
  Description of Artificial Sequence: Synthetic peptide
  Seed: VLQAAIPLTSCGSSPVPGTT (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTT

SEQ ID NO: 340263 - protein, 20 aa, Artificial Sequence
  Description of Artificial Sequence: Synthetic peptide
  Seed: VLQAAIPLTSCGSSPVPGTT (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTT

SEQ ID NO: 340264 - protein, 21 aa, Artificial Sequence
  Description of Artificial Sequence: Synthetic peptide
  Seed: VLQAAIPLTSCGSSPVPGTTD (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGTTD

SEQ ID NO: 340265 - protein, 21 aa, Artificial Sequence
  Description of Artificial Sequence: Synthetic peptide
  Seed: VLQAAIPLTSCGSSPVPGTTD (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTTD

SEQ ID NO: 340266 - protein, 21 aa, Artificial Sequence
  Description of Artificial Sequence: Synthetic peptide
  Seed: VLQAAIPLTSCGSSPVPGTTD (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTTD

SEQ ID NO: 340267 - protein, 22 aa, Artificial Sequence
  Description of Artificial Sequence: Synthetic peptide
  Seed: VLQAAIPLTSCGSSPVPGTTDG (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGTTDG

SEQ ID NO: 340268 - protein, 22 aa, Artificial Sequence
  Description of Artificial Sequence: Synthetic peptide
  Seed: VLQAAIPLTSCGSSPVPGTTDG (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTTDG

SEQ ID NO: 340269 - protein, 22 aa, Artificial Sequence
  Description of Artificial Sequence: Synthetic peptide
  Seed: VLQAAIPLTSCGSSPVPGTTDG (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTTDG

SEQ ID NO: 340270 - protein, 23 aa, Artificial Sequence
  Description of Artificial Sequence: Synthetic peptide
  Seed: VLQAAIPLTSCGSSPVPGTTDGH (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGTTDGH

SEQ ID NO: 340271 - protein, 23 aa, Artificial Sequence
  Description of Artificial Sequence: Synthetic peptide
  Seed: VLQAAIPLTSCGSSPVPGTTDGH (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTTDGH

SEQ ID NO: 340272 - protein, 23 aa, Artificial Sequence
  Description of Artificial Sequence: Synthetic peptide
  Seed: VLQAAIPLTSCGSSPVPGTTDGH (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTTDGH

SEQ ID NO: 340273 - protein, 24 aa, Artificial Sequence
  Description of Artificial Sequence: Synthetic peptide
  Seed: VLQAAIPLTSCGSSPVPGTTDGHR (PMEL_HUMAN)
  Core: LQAAIPLTS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXQAXIXLTXCGSSPVPGTTDGHR

SEQ ID NO: 340274 - protein, 24 aa, Artificial Sequence
  Description of Artificial Sequence: Synthetic peptide
  Seed: VLQAAIPLTSCGSSPVPGTTDGHR (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTTDGHR

SEQ ID NO: 340275 - protein, 24 aa, Artificial Sequence
  Description of Artificial Sequence: Synthetic peptide
  Seed: VLQAAIPLTSCGSSPVPGTTDGHR (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTTDGHR

SEQ ID NO: 340276 - protein, 25 aa, Artificial Sequence
  Description of Artificial Sequence: Synthetic peptide
  Seed: VLQAAIPLTSCGSSPVPGTTDGHRP (PMEL_HUMAN)
  Core: LTSCGSSPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPXTSXGXSPXPGTTDGHRP

SEQ ID NO: 340277 - protein, 25 aa, Artificial Sequence
  Description of Artificial Sequence: Synthetic peptide
  Seed: VLQAAIPLTSCGSSPVPGTTDGHRP (PMEL_HUMAN)
  Core: SCGSSPVPG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTXCGXSXVPXTTDGHRP

SEQ ID NO: 340278 - protein, 25 aa, Artificial Sequence
  Description of Artificial Sequence: Synthetic peptide
  Seed: VLQAAIPLTSCGSSPVPGTTDGHRP (PMEL_HUMAN)
  Core: PVPGTTDGH
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLQAAIPLTSCGSSXVPXTXDGXRP

SEQ ID NO: 340279 - protein, 13 aa, Artificial Sequence
  Description of Artificial Sequence: Synthetic peptide
  Seed: VLSGTTAAQVTTT (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTT

SEQ ID NO: 340280 - protein, 13 aa, Artificial Sequence
  Description of Artificial Sequence: Synthetic peptide
  Seed: VLSGTTAAQVTTT (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTX

SEQ ID NO: 340281 - protein, 14 aa, Artificial Sequence
  Description of Artificial Sequence: Synthetic peptide
  Seed: VLSGTTAAQVTTTE (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTE

SEQ ID NO: 340282 - protein, 14 aa, Artificial Sequence
  Description of Artificial Sequence: Synthetic peptide
  Seed: VLSGTTAAQVTTTE (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXE

SEQ ID NO: 340283 - protein, 15 aa, Artificial Sequence
  Description of Artificial Sequence: Synthetic peptide
  Seed: VLSGTTAAQVTTTEW (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTEW

SEQ ID NO: 340284 - protein, 15 aa, Artificial Sequence
  Description of Artificial Sequence: Synthetic peptide
  Seed: VLSGTTAAQVTTTEW (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEW

SEQ ID NO: 340285 - protein, 16 aa, Artificial Sequence
  Description of Artificial Sequence: Synthetic peptide
  Seed: VLSGTTAAQVTTTEWV (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTEWV

SEQ ID NO: 340286 - protein, 16 aa, Artificial Sequence
  Description of Artificial Sequence: Synthetic peptide
  Seed: VLSGTTAAQVTTTEWV (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWV

SEQ ID NO: 340287 - protein, 17 aa, Artificial Sequence
  Description of Artificial Sequence: Synthetic peptide
  Seed: VLSGTTAAQVTTTEWVE (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTEWVE

SEQ ID NO: 340288 - protein, 17 aa, Artificial Sequence
  Description of Artificial Sequence: Synthetic peptide
  Seed: VLSGTTAAQVTTTEWVE (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVE

SEQ ID NO: 340289 - protein, 18 aa, Artificial Sequence
  Description of Artificial Sequence: Synthetic peptide
  Seed: VLSGTTAAQVTTTEWVET (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVET

SEQ ID NO: 340290 - protein, 18 aa, Artificial Sequence
  Description of Artificial Sequence: Synthetic peptide
  Seed: VLSGTTAAQVTTTEWVET (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXT

SEQ ID NO: 340291 - protein, 19 aa, Artificial Sequence
  Description of Artificial Sequence: Synthetic peptide
  Seed: VLSGTTAAQVTTTEWVETT (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTEWVETT

SEQ ID NO: 340292 - protein, 19 aa, Artificial Sequence
  Description of Artificial Sequence: Synthetic peptide
  Seed: VLSGTTAAQVTTTEWVETT (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETT

SEQ ID NO: 340293 - protein, 19 aa, Artificial Sequence
  Description of Artificial Sequence: Synthetic peptide
  Seed: VLSGTTAAQVTTTEWVETT (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTT

SEQ ID NO: 340294 - protein, 19 aa, Artificial Sequence
  Description of Artificial Sequence: Synthetic peptide
  Seed: VLSGTTAAQVTTTEWVETT (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXT

SEQ ID NO: 340295 - protein, 20 aa, Artificial Sequence
  Description of Artificial Sequence: Synthetic peptide
  Seed: VLSGTTAAQVTTTEWVETTA (PMEL_HUMAN)
  Core: LSGTTAAQV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSGXTXAQXTTTEWVETTA

SEQ ID NO: 340296 - protein, 20 aa, Artificial Sequence
  Description of Artificial Sequence: Synthetic peptide
  Seed: VLSGTTAAQVTTTEWVETTA (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTA

SEQ ID NO: 340297 - protein, 20 aa, Artificial Sequence
  Description of Artificial Sequence: Synthetic peptide
  Seed: VLSGTTAAQVTTTEWVETTA (PMEL_HUMAN)
  Core: AQVTTTEWV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAXQVXTXEWXETTA

SEQ ID NO: 340298 - protein, 20 aa, Artificial Sequence
  Description of Artificial Sequence: Synthetic peptide
  Seed: VLSGTTAAQVTTTEWVETTA (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTA

SEQ ID NO: 340299 - protein, 20 aa, Artificial Sequence
  Description of Artificial Sequence: Synthetic peptide
  Seed: VLSGTTAAQVTTTEWVETTA (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTA

SEQ ID NO: 340300 - protein, 21 aa, Artificial Sequence
  Description of Artificial Sequence: Synthetic peptide
  Seed: VLSGTTAAQVTTTEWVETTAR (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTAR

SEQ ID NO: 340301 - protein, 21 aa, Artificial Sequence
  Description of Artificial Sequence: Synthetic peptide
  Seed: VLSGTTAAQVTTTEWVETTAR (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTAR

SEQ ID NO: 340302 - protein, 21 aa, Artificial Sequence
  Description of Artificial Sequence: Synthetic peptide
  Seed: VLSGTTAAQVTTTEWVETTAR (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTAR

SEQ ID NO: 340303 - protein, 22 aa, Artificial Sequence
  Description of Artificial Sequence: Synthetic peptide
  Seed: VLSGTTAAQVTTTEWVETTARE (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTARE

SEQ ID NO: 340304 - protein, 22 aa, Artificial Sequence
  Description of Artificial Sequence: Synthetic peptide
  Seed: VLSGTTAAQVTTTEWVETTARE (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTARE

SEQ ID NO: 340305 - protein, 22 aa, Artificial Sequence
  Description of Artificial Sequence: Synthetic peptide
  Seed: VLSGTTAAQVTTTEWVETTARE (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTARE

SEQ ID NO: 340306 - protein, 22 aa, Artificial Sequence
  Description of Artificial Sequence: Synthetic peptide
  Seed: VLSGTTAAQVTTTEWVETTARE (PMEL_HUMAN)
  Core: TTEWVETTA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTXTEXVXTTXRE

SEQ ID NO: 340307 - protein, 23 aa, Artificial Sequence
  Description of Artificial Sequence: Synthetic peptide
  Seed: VLSGTTAAQVTTTEWVETTAREL (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTAREL

SEQ ID NO: 340308 - protein, 23 aa, Artificial Sequence
  Description of Artificial Sequence: Synthetic peptide
  Seed: VLSGTTAAQVTTTEWVETTAREL (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTAREL

SEQ ID NO: 340309 - protein, 23 aa, Artificial Sequence
  Description of Artificial Sequence: Synthetic peptide
  Seed: VLSGTTAAQVTTTEWVETTAREL (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTAREL

SEQ ID NO: 340310 - protein, 23 aa, Artificial Sequence
  Description of Artificial Sequence: Synthetic peptide
  Seed: VLSGTTAAQVTTTEWVETTAREL (PMEL_HUMAN)
  Core: TTEWVETTA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTXTEXVXTTXREL

SEQ ID NO: 340311 - protein, 23 aa, Artificial Sequence
  Description of Artificial Sequence: Synthetic peptide
  Seed: VLSGTTAAQVTTTEWVETTAREL (PMEL_HUMAN)
  Core: WVETTAREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTTTEXVEXTXREX

SEQ ID NO: 340312 - protein, 24 aa, Artificial Sequence
  Description of Artificial Sequence: Synthetic peptide
  Seed: VLSGTTAAQVTTTEWVETTARELP (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTARELP

SEQ ID NO: 340313 - protein, 24 aa, Artificial Sequence
  Description of Artificial Sequence: Synthetic peptide
  Seed: VLSGTTAAQVTTTEWVETTARELP (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTARELP

SEQ ID NO: 340314 - protein, 24 aa, Artificial Sequence
  Description of Artificial Sequence: Synthetic peptide
  Seed: VLSGTTAAQVTTTEWVETTARELP (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTARELP

SEQ ID NO: 340315 - protein, 24 aa, Artificial Sequence
  Description of Artificial Sequence: Synthetic peptide
  Seed: VLSGTTAAQVTTTEWVETTARELP (PMEL_HUMAN)
  Core: TTTEWVETT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVXTTXWXETXARELP

SEQ ID NO: 340316 - protein, 24 aa, Artificial Sequence
  Description of Artificial Sequence: Synthetic peptide
  Seed: VLSGTTAAQVTTTEWVETTARELP (PMEL_HUMAN)
  Core: TTEWVETTA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTXTEXVXTTXRELP

SEQ ID NO: 340317 - protein, 24 aa, Artificial Sequence
  Description of Artificial Sequence: Synthetic peptide
  Seed: VLSGTTAAQVTTTEWVETTARELP (PMEL_HUMAN)
  Core: WVETTAREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTTTEXVEXTXREXP

SEQ ID NO: 340318 - protein, 25 aa, Artificial Sequence
  Description of Artificial Sequence: Synthetic peptide
  Seed: VLSGTTAAQVTTTEWVETTARELPI (PMEL_HUMAN)
  Core: TTAAQVTTT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLSGXTAXQXTTXEWVETTARELPI

SEQ ID NO: 340319 - protein, 25 aa, Artificial Sequence
  Description of Artificial Sequence: Synthetic peptide
  Seed: VLSGTTAAQVTTTEWVETTARELPI (PMEL_HUMAN)
  Core: QVTTTEWVE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAXVTXTXWVXTTARELPI

SEQ ID NO: 340320 - protein, 25 aa, Artificial Sequence
  Description of Artificial Sequence: Synthetic peptide
  Seed: VLSGTTAAQVTTTEWVETTARELPI (PMEL_HUMAN)
  Core: VTTTEWVET
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQXTTXEXVEXTARELPI

SEQ ID NO: 340321 - protein, 25 aa, Artificial Sequence
  Description of Artificial Sequence: Synthetic peptide
  Seed: VLSGTTAAQVTTTEWVETTARELPI (PMEL_HUMAN)
  Core: TTTEWVETT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVXTTXWXETXARELPI

SEQ ID NO: 340322 - protein, 25 aa, Artificial Sequence
  Description of Artificial Sequence: Synthetic peptide
  Seed: VLSGTTAAQVTTTEWVETTARELPI (PMEL_HUMAN)
  Core: WVETTAREL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLSGTTAAQVTTTEXVEXTXREXPI

SEQ ID NO: 340323 - protein, 13 aa, Artificial Sequence
  Description of Artificial Sequence: Synthetic peptide
  Seed: VLYRYGSFSVTLD (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLD

SEQ ID NO: 340324 - protein, 13 aa, Artificial Sequence
  Description of Artificial Sequence: Synthetic peptide
  Seed: VLYRYGSFSVTLD (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLD

SEQ ID NO: 340325 - protein, 14 aa, Artificial Sequence
  Description of Artificial Sequence: Synthetic peptide
  Seed: VLYRYGSFSVTLDI (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDI

SEQ ID NO: 340326 - protein, 14 aa, Artificial Sequence
  Description of Artificial Sequence: Synthetic peptide
  Seed: VLYRYGSFSVTLDI (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDI

SEQ ID NO: 340327 - protein, 14 aa, Artificial Sequence
  Description of Artificial Sequence: Synthetic peptide
  Seed: VLYRYGSFSVTLDI (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDI

SEQ ID NO: 340328 - protein, 14 aa, Artificial Sequence
  Description of Artificial Sequence: Synthetic peptide
  Seed: VLYRYGSFSVTLDI (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXI

SEQ ID NO: 340329 - protein, 16 aa, Artificial Sequence
  Description of Artificial Sequence: Synthetic peptide
  Seed: VLYRYGSFSVTLDIVQ (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQ

SEQ ID NO: 340330 - protein, 16 aa, Artificial Sequence
  Description of Artificial Sequence: Synthetic peptide
  Seed: VLYRYGSFSVTLDIVQ (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQ

SEQ ID NO: 340331 - protein, 16 aa, Artificial Sequence
  Description of Artificial Sequence: Synthetic peptide
  Seed: VLYRYGSFSVTLDIVQ (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQ

SEQ ID NO: 340332 - protein, 16 aa, Artificial Sequence
  Description of Artificial Sequence: Synthetic peptide
  Seed: VLYRYGSFSVTLDIVQ (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQ

SEQ ID NO: 340333 - protein, 16 aa, Artificial Sequence
  Description of Artificial Sequence: Synthetic peptide
  Seed: VLYRYGSFSVTLDIVQ (PMEL_HUMAN)
  Core: SFSVTLDIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGXFSXTXDIXQ

SEQ ID NO: 340334 - protein, 16 aa, Artificial Sequence
  Description of Artificial Sequence: Synthetic peptide
  Seed: VLYRYGSFSVTLDIVQ (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVX

SEQ ID NO: 340335 - protein, 17 aa, Artificial Sequence
  Description of Artificial Sequence: Synthetic peptide
  Seed: VLYRYGSFSVTLDIVQG (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQG

SEQ ID NO: 340336 - protein, 17 aa, Artificial Sequence
  Description of Artificial Sequence: Synthetic peptide
  Seed: VLYRYGSFSVTLDIVQG (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQG

SEQ ID NO: 340337 - protein, 17 aa, Artificial Sequence
  Description of Artificial Sequence: Synthetic peptide
  Seed: VLYRYGSFSVTLDIVQG (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQG

SEQ ID NO: 340338 - protein, 17 aa, Artificial Sequence
  Description of Artificial Sequence: Synthetic peptide
  Seed: VLYRYGSFSVTLDIVQG (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQG

SEQ ID NO: 340339 - protein, 17 aa, Artificial Sequence
  Description of Artificial Sequence: Synthetic peptide
  Seed: VLYRYGSFSVTLDIVQG (PMEL_HUMAN)
  Core: SFSVTLDIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGXFSXTXDIXQG

SEQ ID NO: 340340 - protein, 17 aa, Artificial Sequence
  Description of Artificial Sequence: Synthetic peptide
  Seed: VLYRYGSFSVTLDIVQG (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXG

SEQ ID NO: 340341 - protein, 18 aa, Artificial Sequence
  Description of Artificial Sequence: Synthetic peptide
  Seed: VLYRYGSFSVTLDIVQGI (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGI

SEQ ID NO: 340342 - protein, 18 aa, Artificial Sequence
  Description of Artificial Sequence: Synthetic peptide
  Seed: VLYRYGSFSVTLDIVQGI (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGI

SEQ ID NO: 340343 - protein, 18 aa, Artificial Sequence
  Description of Artificial Sequence: Synthetic peptide
  Seed: VLYRYGSFSVTLDIVQGI (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGI

SEQ ID NO: 340344 - protein, 18 aa, Artificial Sequence
  Description of Artificial Sequence: Synthetic peptide
  Seed: VLYRYGSFSVTLDIVQGI (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGI

SEQ ID NO: 340345 - protein, 18 aa, Artificial Sequence
  Description of Artificial Sequence: Synthetic peptide
  Seed: VLYRYGSFSVTLDIVQGI (PMEL_HUMAN)
  Core: SFSVTLDIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGXFSXTXDIXQGI

SEQ ID NO: 340346 - protein, 18 aa, Artificial Sequence
  Description of Artificial Sequence: Synthetic peptide
  Seed: VLYRYGSFSVTLDIVQGI (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGI

SEQ ID NO: 340347 - protein, 19 aa, Artificial Sequence
  Description of Artificial Sequence: Synthetic peptide
  Seed: VLYRYGSFSVTLDIVQGIE (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIE

SEQ ID NO: 340348 - protein, 19 aa, Artificial Sequence
  Description of Artificial Sequence: Synthetic peptide
  Seed: VLYRYGSFSVTLDIVQGIE (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIE

SEQ ID NO: 340349 - protein, 19 aa, Artificial Sequence
  Description of Artificial Sequence: Synthetic peptide
  Seed: VLYRYGSFSVTLDIVQGIE (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIE

SEQ ID NO: 340350 - protein, 19 aa, Artificial Sequence
  Description of Artificial Sequence: Synthetic peptide
  Seed: VLYRYGSFSVTLDIVQGIE (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIE

SEQ ID NO: 340351 - protein, 19 aa, Artificial Sequence
  Description of Artificial Sequence: Synthetic peptide
  Seed: VLYRYGSFSVTLDIVQGIE (PMEL_HUMAN)
  Core: SFSVTLDIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGXFSXTXDIXQGIE

SEQ ID NO: 340352 - protein, 19 aa, Artificial Sequence
  Description of Artificial Sequence: Synthetic peptide
  Seed: VLYRYGSFSVTLDIVQGIE (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIE

SEQ ID NO: 340353 - protein, 20 aa, Artificial Sequence
  Description of Artificial Sequence: Synthetic peptide
  Seed: VLYRYGSFSVTLDIVQGIES (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIES

SEQ ID NO: 340354 - protein, 20 aa, Artificial Sequence
  Description of Artificial Sequence: Synthetic peptide
  Seed: VLYRYGSFSVTLDIVQGIES (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIES

SEQ ID NO: 340355 - protein, 20 aa, Artificial Sequence
  Description of Artificial Sequence: Synthetic peptide
  Seed: VLYRYGSFSVTLDIVQGIES (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIES

SEQ ID NO: 340356 - protein, 20 aa, Artificial Sequence
  Description of Artificial Sequence: Synthetic peptide
  Seed: VLYRYGSFSVTLDIVQGIES (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIES

SEQ ID NO: 340357 - protein, 20 aa, Artificial Sequence
  Description of Artificial Sequence: Synthetic peptide
  Seed: VLYRYGSFSVTLDIVQGIES (PMEL_HUMAN)
  Core: SFSVTLDIV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGXFSXTXDIXQGIES

SEQ ID NO: 340358 - protein, 20 aa, Artificial Sequence
  Description of Artificial Sequence: Synthetic peptide
  Seed: VLYRYGSFSVTLDIVQGIES (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIES

SEQ ID NO: 340359 - protein, 20 aa, Artificial Sequence
  Description of Artificial Sequence: Synthetic peptide
  Seed: VLYRYGSFSVTLDIVQGIES (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXES

SEQ ID NO: 340360 - protein, 21 aa, Artificial Sequence
  Description of Artificial Sequence: Synthetic peptide
  Seed: VLYRYGSFSVTLDIVQGIESA (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIESA

SEQ ID NO: 340361 - protein, 21 aa, Artificial Sequence
  Description of Artificial Sequence: Synthetic peptide
  Seed: VLYRYGSFSVTLDIVQGIESA (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIESA

SEQ ID NO: 340362 - protein, 21 aa, Artificial Sequence
  Description of Artificial Sequence: Synthetic peptide
  Seed: VLYRYGSFSVTLDIVQGIESA (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIESA

SEQ ID NO: 340363 - protein, 21 aa, Artificial Sequence
  Description of Artificial Sequence: Synthetic peptide
  Seed: VLYRYGSFSVTLDIVQGIESA (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIESA

SEQ ID NO: 340364 - protein, 21 aa, Artificial Sequence
  Description of Artificial Sequence: Synthetic peptide
  Seed: VLYRYGSFSVTLDIVQGIESA (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIESA

SEQ ID NO: 340365 - protein, 21 aa, Artificial Sequence
  Description of Artificial Sequence: Synthetic peptide
  Seed: VLYRYGSFSVTLDIVQGIESA (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXESA

SEQ ID NO: 340366 - protein, 22 aa, Artificial Sequence
  Description of Artificial Sequence: Synthetic peptide
  Seed: VLYRYGSFSVTLDIVQGIESAE (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIESAE

SEQ ID NO: 340367 - protein, 22 aa, Artificial Sequence
  Description of Artificial Sequence: Synthetic peptide
  Seed: VLYRYGSFSVTLDIVQGIESAE (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIESAE

SEQ ID NO: 340368 - protein, 22 aa, Artificial Sequence
  Description of Artificial Sequence: Synthetic peptide
  Seed: VLYRYGSFSVTLDIVQGIESAE (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIESAE

SEQ ID NO: 340369 - protein, 22 aa, Artificial Sequence
  Description of Artificial Sequence: Synthetic peptide
  Seed: VLYRYGSFSVTLDIVQGIESAE (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIESAE

SEQ ID NO: 340370 - protein, 22 aa, Artificial Sequence
  Description of Artificial Sequence: Synthetic peptide
  Seed: VLYRYGSFSVTLDIVQGIESAE (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIESAE

SEQ ID NO: 340371 - protein, 22 aa, Artificial Sequence
  Description of Artificial Sequence: Synthetic peptide
  Seed: VLYRYGSFSVTLDIVQGIESAE (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXESAE

SEQ ID NO: 340372 - protein, 22 aa, Artificial Sequence
  Description of Artificial Sequence: Synthetic peptide
  Seed: VLYRYGSFSVTLDIVQGIESAE (PMEL_HUMAN)
  Core: LDIVQGIES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTXDIXQXIEXAE

SEQ ID NO: 340373 - protein, 23 aa, Artificial Sequence
  Description of Artificial Sequence: Synthetic peptide
  Seed: VLYRYGSFSVTLDIVQGIESAEI (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIESAEI

SEQ ID NO: 340374 - protein, 23 aa, Artificial Sequence
  Description of Artificial Sequence: Synthetic peptide
  Seed: VLYRYGSFSVTLDIVQGIESAEI (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIESAEI

SEQ ID NO: 340375 - protein, 23 aa, Artificial Sequence
  Description of Artificial Sequence: Synthetic peptide
  Seed: VLYRYGSFSVTLDIVQGIESAEI (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIESAEI

SEQ ID NO: 340376 - protein, 23 aa, Artificial Sequence
  Description of Artificial Sequence: Synthetic peptide
  Seed: VLYRYGSFSVTLDIVQGIESAEI (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIESAEI

SEQ ID NO: 340377 - protein, 23 aa, Artificial Sequence
  Description of Artificial Sequence: Synthetic peptide
  Seed: VLYRYGSFSVTLDIVQGIESAEI (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIESAEI

SEQ ID NO: 340378 - protein, 23 aa, Artificial Sequence
  Description of Artificial Sequence: Synthetic peptide
  Seed: VLYRYGSFSVTLDIVQGIESAEI (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXESAEI

SEQ ID NO: 340379 - protein, 23 aa, Artificial Sequence
  Description of Artificial Sequence: Synthetic peptide
  Seed: VLYRYGSFSVTLDIVQGIESAEI (PMEL_HUMAN)
  Core: LDIVQGIES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTXDIXQXIEXAEI

SEQ ID NO: 340380 - protein, 23 aa, Artificial Sequence
  Description of Artificial Sequence: Synthetic peptide
  Seed: VLYRYGSFSVTLDIVQGIESAEI (PMEL_HUMAN)
  Core: VQGIESAEI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTLDIXQGXEXAEX

SEQ ID NO: 340381 - protein, 24 aa, Artificial Sequence
  Description of Artificial Sequence: Synthetic peptide
  Seed: VLYRYGSFSVTLDIVQGIESAEIL (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIESAEIL

SEQ ID NO: 340382 - protein, 24 aa, Artificial Sequence
  Description of Artificial Sequence: Synthetic peptide
  Seed: VLYRYGSFSVTLDIVQGIESAEIL (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIESAEIL

SEQ ID NO: 340383 - protein, 24 aa, Artificial Sequence
  Description of Artificial Sequence: Synthetic peptide
  Seed: VLYRYGSFSVTLDIVQGIESAEIL (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIESAEIL

SEQ ID NO: 340384 - protein, 24 aa, Artificial Sequence
  Description of Artificial Sequence: Synthetic peptide
  Seed: VLYRYGSFSVTLDIVQGIESAEIL (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIESAEIL

SEQ ID NO: 340385 - protein, 24 aa, Artificial Sequence
  Description of Artificial Sequence: Synthetic peptide
  Seed: VLYRYGSFSVTLDIVQGIESAEIL (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIESAEIL

SEQ ID NO: 340386 - protein, 24 aa, Artificial Sequence
  Description of Artificial Sequence: Synthetic peptide
  Seed: VLYRYGSFSVTLDIVQGIESAEIL (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXESAEIL

SEQ ID NO: 340387 - protein, 24 aa, Artificial Sequence
  Description of Artificial Sequence: Synthetic peptide
  Seed: VLYRYGSFSVTLDIVQGIESAEIL (PMEL_HUMAN)
  Core: LDIVQGIES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTXDIXQXIEXAEIL

SEQ ID NO: 340388 - protein, 24 aa, Artificial Sequence
  Description of Artificial Sequence: Synthetic peptide
  Seed: VLYRYGSFSVTLDIVQGIESAEIL (PMEL_HUMAN)
  Core: VQGIESAEI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTLDIXQGXEXAEXL

SEQ ID NO: 340389 - protein, 25 aa, Artificial Sequence
  Description of Artificial Sequence: Synthetic peptide
  Seed: VLYRYGSFSVTLDIVQGIESAEILQ (PMEL_HUMAN)
  Core: LYRYGSFSV
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXYRXGXFSXTLDIVQGIESAEILQ

SEQ ID NO: 340390 - protein, 25 aa, Artificial Sequence
  Description of Artificial Sequence: Synthetic peptide
  Seed: VLYRYGSFSVTLDIVQGIESAEILQ (PMEL_HUMAN)
  Core: YRYGSFSVT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VLXRYXSXSVXLDIVQGIESAEILQ

SEQ ID NO: 340391 - protein, 25 aa, Artificial Sequence
  Description of Artificial Sequence: Synthetic peptide
  Seed: VLYRYGSFSVTLDIVQGIESAEILQ (PMEL_HUMAN)
  Core: RYGSFSVTL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VLYXYGXFXVTXDIVQGIESAEILQ

SEQ ID NO: 340392 - protein, 25 aa, Artificial Sequence
  Description of Artificial Sequence: Synthetic peptide
  Seed: VLYRYGSFSVTLDIVQGIESAEILQ (PMEL_HUMAN)
  Core: YGSFSVTLD
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VLYRXGSXSXTLXIVQGIESAEILQ

SEQ ID NO: 340393 - protein, 25 aa, Artificial Sequence
  Description of Artificial Sequence: Synthetic peptide
  Seed: VLYRYGSFSVTLDIVQGIESAEILQ (PMEL_HUMAN)
  Core: FSVTLDIVQ
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSXSVXLXIVXGIESAEILQ

SEQ ID NO: 340394 - protein, 25 aa, Artificial Sequence
  Description of Artificial Sequence: Synthetic peptide
  Seed: VLYRYGSFSVTLDIVQGIESAEILQ (PMEL_HUMAN)
  Core: VTLDIVQGI
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSXTLXIXQGXESAEILQ

SEQ ID NO: 340395 - protein, 25 aa, Artificial Sequence
  Description of Artificial Sequence: Synthetic peptide
  Seed: VLYRYGSFSVTLDIVQGIESAEILQ (PMEL_HUMAN)
  Core: LDIVQGIES
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTXDIXQXIEXAEILQ

SEQ ID NO: 340396 - protein, 25 aa, Artificial Sequence
  Description of Artificial Sequence: Synthetic peptide
  Seed: VLYRYGSFSVTLDIVQGIESAEILQ (PMEL_HUMAN)
  Core: VQGIESAEI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VLYRYGSFSVTLDIXQGXEXAEXLQ

SEQ ID NO: 340397 - protein, 14 aa, Artificial Sequence
  Description of Artificial Sequence: Synthetic peptide
  Seed: VMGTTLAEMSTPEA (PMEL_HUMAN)
  Core: MGTTLAEMS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXGTXLXEMXTPEA

SEQ ID NO: 340398 - protein, 15 aa, Artificial Sequence
  Description of Artificial Sequence: Synthetic peptide
  Seed: VMGTTLAEMSTPEAT (PMEL_HUMAN)
  Core: MGTTLAEMS
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXGTXLXEMXTPEAT

SEQ ID NO: 340399 - protein, 15 aa, Artificial Sequence
  Description of Artificial Sequence: Synthetic peptide
  Seed: VMGTTLAEMSTPEAT (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXT

SEQ ID NO: 340400 - protein, 15 aa, Artificial Sequence
  Description of Artificial Sequence: Synthetic peptide
  Seed: VMGTTLAEMSTPEAT (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAX

SEQ ID NO: 340401 - protein, 16 aa, Artificial Sequence
  Description of Artificial Sequence: Synthetic peptide
  Seed: VMGTTLAEMSTPEATG (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTG

SEQ ID NO: 340402 - protein, 16 aa, Artificial Sequence
  Description of Artificial Sequence: Synthetic peptide
  Seed: VMGTTLAEMSTPEATG (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXG

SEQ ID NO: 340403 - protein, 17 aa, Artificial Sequence
  Description of Artificial Sequence: Synthetic peptide
  Seed: VMGTTLAEMSTPEATGM (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGM

SEQ ID NO: 340404 - protein, 17 aa, Artificial Sequence
  Description of Artificial Sequence: Synthetic peptide
  Seed: VMGTTLAEMSTPEATGM (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGM

SEQ ID NO: 340405 - protein, 18 aa, Artificial Sequence
  Description of Artificial Sequence: Synthetic peptide
  Seed: VMGTTLAEMSTPEATGMT (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMT

SEQ ID NO: 340406 - protein, 19 aa, Artificial Sequence
  Description of Artificial Sequence: Synthetic peptide
  Seed: VMGTTLAEMSTPEATGMTP (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTP

SEQ ID NO: 340407 - protein, 19 aa, Artificial Sequence
  Description of Artificial Sequence: Synthetic peptide
  Seed: VMGTTLAEMSTPEATGMTP (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTP

SEQ ID NO: 340408 - protein, 20 aa, Artificial Sequence
  Description of Artificial Sequence: Synthetic peptide
  Seed: VMGTTLAEMSTPEATGMTPA (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPA

SEQ ID NO: 340409 - protein, 20 aa, Artificial Sequence
  Description of Artificial Sequence: Synthetic peptide
  Seed: VMGTTLAEMSTPEATGMTPA (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPA

SEQ ID NO: 340410 - protein, 21 aa, Artificial Sequence
  Description of Artificial Sequence: Synthetic peptide
  Seed: VMGTTLAEMSTPEATGMTPAE (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPAE

SEQ ID NO: 340411 - protein, 21 aa, Artificial Sequence
  Description of Artificial Sequence: Synthetic peptide
  Seed: VMGTTLAEMSTPEATGMTPAE (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPAE

SEQ ID NO: 340412 - protein, 22 aa, Artificial Sequence
  Description of Artificial Sequence: Synthetic peptide
  Seed: VMGTTLAEMSTPEATGMTPAEV (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPAEV

SEQ ID NO: 340413 - protein, 22 aa, Artificial Sequence
  Description of Artificial Sequence: Synthetic peptide
  Seed: VMGTTLAEMSTPEATGMTPAEV (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPAEV

SEQ ID NO: 340414 - protein, 23 aa, Artificial Sequence
  Description of Artificial Sequence: Synthetic peptide
  Seed: VMGTTLAEMSTPEATGMTPAEVS (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPAEVS

SEQ ID NO: 340415 - protein, 23 aa, Artificial Sequence
  Description of Artificial Sequence: Synthetic peptide
  Seed: VMGTTLAEMSTPEATGMTPAEVS (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPAEVS

SEQ ID NO: 340416 - protein, 23 aa, Artificial Sequence
  Description of Artificial Sequence: Synthetic peptide
  Seed: VMGTTLAEMSTPEATGMTPAEVS (PMEL_HUMAN)
  Core: ATGMTPAEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLAEMSTPEXTGXTXAEXS

SEQ ID NO: 340417 - protein, 24 aa, Artificial Sequence
  Description of Artificial Sequence: Synthetic peptide
  Seed: VMGTTLAEMSTPEATGMTPAEVSI (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPAEVSI

SEQ ID NO: 340418 - protein, 24 aa, Artificial Sequence
  Description of Artificial Sequence: Synthetic peptide
  Seed: VMGTTLAEMSTPEATGMTPAEVSI (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPAEVSI

SEQ ID NO: 340419 - protein, 24 aa, Artificial Sequence
  Description of Artificial Sequence: Synthetic peptide
  Seed: VMGTTLAEMSTPEATGMTPAEVSI (PMEL_HUMAN)
  Core: ATGMTPAEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLAEMSTPEXTGXTXAEXSI

SEQ ID NO: 340420 - protein, 25 aa, Artificial Sequence
  Description of Artificial Sequence: Synthetic peptide
  Seed: VMGTTLAEMSTPEATGMTPAEVSIV (PMEL_HUMAN)
  Core: LAEMSTPEA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTXAEXSXPEXTGMTPAEVSIV

SEQ ID NO: 340421 - protein, 25 aa, Artificial Sequence
  Description of Artificial Sequence: Synthetic peptide
  Seed: VMGTTLAEMSTPEATGMTPAEVSIV (PMEL_HUMAN)
  Core: AEMSTPEAT
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLXEMXTXEAXGMTPAEVSIV

SEQ ID NO: 340422 - protein, 25 aa, Artificial Sequence
  Description of Artificial Sequence: Synthetic peptide
  Seed: VMGTTLAEMSTPEATGMTPAEVSIV (PMEL_HUMAN)
  Core: EATGMTPAE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLAEMSTPXATXMXPAXVSIV

SEQ ID NO: 340423 - protein, 25 aa, Artificial Sequence
  Description of Artificial Sequence: Synthetic peptide
  Seed: VMGTTLAEMSTPEATGMTPAEVSIV (PMEL_HUMAN)
  Core: ATGMTPAEV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VMGTTLAEMSTPEXTGXTXAEXSIV

SEQ ID NO: 340424 - protein, 14 aa, Artificial Sequence
  Description of Artificial Sequence: Synthetic peptide
  Seed: VNNTIINGSQVWGG (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGX

SEQ ID NO: 340425 - protein, 15 aa, Artificial Sequence
  Description of Artificial Sequence: Synthetic peptide
  Seed: VNNTIINGSQVWGGQ (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQ

SEQ ID NO: 340426 - protein, 16 aa, Artificial Sequence
  Description of Artificial Sequence: Synthetic peptide
  Seed: VNNTIINGSQVWGGQP (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQP

SEQ ID NO: 340427 - protein, 17 aa, Artificial Sequence
  Description of Artificial Sequence: Synthetic peptide
  Seed: VNNTIINGSQVWGGQPV (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPV

SEQ ID NO: 340428 - protein, 18 aa, Artificial Sequence
  Description of Artificial Sequence: Synthetic peptide
  Seed: VNNTIINGSQVWGGQPVY (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVY

SEQ ID NO: 340429 - protein, 19 aa, Artificial Sequence
  Description of Artificial Sequence: Synthetic peptide
  Seed: VNNTIINGSQVWGGQPVYP (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYP

SEQ ID NO: 340430 - protein, 20 aa, Artificial Sequence
  Description of Artificial Sequence: Synthetic peptide
  Seed: VNNTIINGSQVWGGQPVYPQ (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQ

SEQ ID NO: 340431 - protein, 21 aa, Artificial Sequence
  Description of Artificial Sequence: Synthetic peptide
  Seed: VNNTIINGSQVWGGQPVYPQE (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQE

SEQ ID NO: 340432 - protein, 21 aa, Artificial Sequence
  Description of Artificial Sequence: Synthetic peptide
  Seed: VNNTIINGSQVWGGQPVYPQE (PMEL_HUMAN)
  Core: VWGGQPVYP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQXWGXQXVYXQE

SEQ ID NO: 340433 - protein, 22 aa, Artificial Sequence
  Description of Artificial Sequence: Synthetic peptide
  Seed: VNNTIINGSQVWGGQPVYPQET (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQET

SEQ ID NO: 340434 - protein, 22 aa, Artificial Sequence
  Description of Artificial Sequence: Synthetic peptide
  Seed: VNNTIINGSQVWGGQPVYPQET (PMEL_HUMAN)
  Core: VWGGQPVYP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQXWGXQXVYXQET

SEQ ID NO: 340435 - protein, 23 aa, Artificial Sequence
  Description of Artificial Sequence: Synthetic peptide
  Seed: VNNTIINGSQVWGGQPVYPQETD (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQETD

SEQ ID NO: 340436 - protein, 23 aa, Artificial Sequence
  Description of Artificial Sequence: Synthetic peptide
  Seed: VNNTIINGSQVWGGQPVYPQETD (PMEL_HUMAN)
  Core: VWGGQPVYP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQXWGXQXVYXQETD

SEQ ID NO: 340437 - protein, 23 aa, Artificial Sequence
  Description of Artificial Sequence: Synthetic peptide
  Seed: VNNTIINGSQVWGGQPVYPQETD (PMEL_HUMAN)
  Core: WGGQPVYPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQVXGGXPXYPXETD

SEQ ID NO: 340438 - protein, 24 aa, Artificial Sequence
  Description of Artificial Sequence: Synthetic peptide
  Seed: VNNTIINGSQVWGGQPVYPQETDD (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQETDD

SEQ ID NO: 340439 - protein, 24 aa, Artificial Sequence
  Description of Artificial Sequence: Synthetic peptide
  Seed: VNNTIINGSQVWGGQPVYPQETDD (PMEL_HUMAN)
  Core: VWGGQPVYP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQXWGXQXVYXQETDD

SEQ ID NO: 340440 - protein, 24 aa, Artificial Sequence
  Description of Artificial Sequence: Synthetic peptide
  Seed: VNNTIINGSQVWGGQPVYPQETDD (PMEL_HUMAN)
  Core: WGGQPVYPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQVXGGXPXYPXETDD

SEQ ID NO: 340441 - protein, 25 aa, Artificial Sequence
  Description of Artificial Sequence: Synthetic peptide
  Seed: VNNTIINGSQVWGGQPVYPQETDDA (PMEL_HUMAN)
  Core: INGSQVWGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIXNGXQXWGXQPVYPQETDDA

SEQ ID NO: 340442 - protein, 25 aa, Artificial Sequence
  Description of Artificial Sequence: Synthetic peptide
  Seed: VNNTIINGSQVWGGQPVYPQETDDA (PMEL_HUMAN)
  Core: VWGGQPVYP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQXWGXQXVYXQETDDA

SEQ ID NO: 340443 - protein, 25 aa, Artificial Sequence
  Description of Artificial Sequence: Synthetic peptide
  Seed: VNNTIINGSQVWGGQPVYPQETDDA (PMEL_HUMAN)
  Core: WGGQPVYPQ
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VNNTIINGSQVXGGXPXYPXETDDA

SEQ ID NO: 340444 - protein, 13 aa, Artificial Sequence
  Description of Artificial Sequence: Synthetic peptide
  Seed: VPFSVSVSQLRAL (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXAL

SEQ ID NO: 340445 - protein, 13 aa, Artificial Sequence
  Description of Artificial Sequence: Synthetic peptide
  Seed: VPFSVSVSQLRAL (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAX

SEQ ID NO: 340446 - protein, 14 aa, Artificial Sequence
  Description of Artificial Sequence: Synthetic peptide
  Seed: VPFSVSVSQLRALD (PMEL_HUMAN)
  Core: PFSVSVSQL
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXFSXSXSQXRALD

SEQ ID NO: 340447 - protein, 14 aa, Artificial Sequence
  Description of Artificial Sequence: Synthetic peptide
  Seed: VPFSVSVSQLRALD (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALD

SEQ ID NO: 340448 - protein, 14 aa, Artificial Sequence
  Description of Artificial Sequence: Synthetic peptide
  Seed: VPFSVSVSQLRALD (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXD

SEQ ID NO: 340449 - protein, 15 aa, Artificial Sequence
  Description of Artificial Sequence: Synthetic peptide
  Seed: VPFSVSVSQLRALDG (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDG

SEQ ID NO: 340450 - protein, 15 aa, Artificial Sequence
  Description of Artificial Sequence: Synthetic peptide
  Seed: VPFSVSVSQLRALDG (PMEL_HUMAN)
  Core: SVSVSQLRA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPFXVSXSXLRXLDG

SEQ ID NO: 340451 - protein, 15 aa, Artificial Sequence
  Description of Artificial Sequence: Synthetic peptide
  Seed: VPFSVSVSQLRALDG (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDG

SEQ ID NO: 340452 - protein, 15 aa, Artificial Sequence
  Description of Artificial Sequence: Synthetic peptide
  Seed: VPFSVSVSQLRALDG (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDX

SEQ ID NO: 340453 - protein, 16 aa, Artificial Sequence
  Description of Artificial Sequence: Synthetic peptide
  Seed: VPFSVSVSQLRALDGG (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGG

SEQ ID NO: 340454 - protein, 16 aa, Artificial Sequence
  Description of Artificial Sequence: Synthetic peptide
  Seed: VPFSVSVSQLRALDGG (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGG

SEQ ID NO: 340455 - protein, 16 aa, Artificial Sequence
  Description of Artificial Sequence: Synthetic peptide
  Seed: VPFSVSVSQLRALDGG (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXG

SEQ ID NO: 340456 - protein, 17 aa, Artificial Sequence
  Description of Artificial Sequence: Synthetic peptide
  Seed: VPFSVSVSQLRALDGGN (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGN

SEQ ID NO: 340457 - protein, 17 aa, Artificial Sequence
  Description of Artificial Sequence: Synthetic peptide
  Seed: VPFSVSVSQLRALDGGN (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGN

SEQ ID NO: 340458 - protein, 17 aa, Artificial Sequence
  Description of Artificial Sequence: Synthetic peptide
  Seed: VPFSVSVSQLRALDGGN (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGN

SEQ ID NO: 340459 - protein, 18 aa, Artificial Sequence
  Description of Artificial Sequence: Synthetic peptide
  Seed: VPFSVSVSQLRALDGGNK (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNK

SEQ ID NO: 340460 - protein, 18 aa, Artificial Sequence
  Description of Artificial Sequence: Synthetic peptide
  Seed: VPFSVSVSQLRALDGGNK (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNK

SEQ ID NO: 340461 - protein, 19 aa, Artificial Sequence
  Description of Artificial Sequence: Synthetic peptide
  Seed: VPFSVSVSQLRALDGGNKH (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKH

SEQ ID NO: 340462 - protein, 19 aa, Artificial Sequence
  Description of Artificial Sequence: Synthetic peptide
  Seed: VPFSVSVSQLRALDGGNKH (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKH

SEQ ID NO: 340463 - protein, 19 aa, Artificial Sequence
  Description of Artificial Sequence: Synthetic peptide
  Seed: VPFSVSVSQLRALDGGNKH (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKH

SEQ ID NO: 340464 - protein, 20 aa, Artificial Sequence
  Description of Artificial Sequence: Synthetic peptide
  Seed: VPFSVSVSQLRALDGGNKHF (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHF

SEQ ID NO: 340465 - protein, 20 aa, Artificial Sequence
  Description of Artificial Sequence: Synthetic peptide
  Seed: VPFSVSVSQLRALDGGNKHF (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHF

SEQ ID NO: 340466 - protein, 20 aa, Artificial Sequence
  Description of Artificial Sequence: Synthetic peptide
  Seed: VPFSVSVSQLRALDGGNKHF (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHF

SEQ ID NO: 340467 - protein, 20 aa, Artificial Sequence
  Description of Artificial Sequence: Synthetic peptide
  Seed: VPFSVSVSQLRALDGGNKHF (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHF

SEQ ID NO: 340468 - protein, 20 aa, Artificial Sequence
  Description of Artificial Sequence: Synthetic peptide
  Seed: VPFSVSVSQLRALDGGNKHF (PMEL_HUMAN)
  Core: RALDGGNKH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLXALXGXNKXF

SEQ ID NO: 340469 - protein, 21 aa, Artificial Sequence
  Description of Artificial Sequence: Synthetic peptide
  Seed: VPFSVSVSQLRALDGGNKHFL (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHFL

SEQ ID NO: 340470 - protein, 21 aa, Artificial Sequence
  Description of Artificial Sequence: Synthetic peptide
  Seed: VPFSVSVSQLRALDGGNKHFL (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHFL

SEQ ID NO: 340471 - protein, 21 aa, Artificial Sequence
  Description of Artificial Sequence: Synthetic peptide
  Seed: VPFSVSVSQLRALDGGNKHFL (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHFL

SEQ ID NO: 340472 - protein, 21 aa, Artificial Sequence
  Description of Artificial Sequence: Synthetic peptide
  Seed: VPFSVSVSQLRALDGGNKHFL (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHFL

SEQ ID NO: 340473 - protein, 22 aa, Artificial Sequence
  Description of Artificial Sequence: Synthetic peptide
  Seed: VPFSVSVSQLRALDGGNKHFLR (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHFLR

SEQ ID NO: 340474 - protein, 22 aa, Artificial Sequence
  Description of Artificial Sequence: Synthetic peptide
  Seed: VPFSVSVSQLRALDGGNKHFLR (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHFLR

SEQ ID NO: 340475 - protein, 22 aa, Artificial Sequence
  Description of Artificial Sequence: Synthetic peptide
  Seed: VPFSVSVSQLRALDGGNKHFLR (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHFLR

SEQ ID NO: 340476 - protein, 22 aa, Artificial Sequence
  Description of Artificial Sequence: Synthetic peptide
  Seed: VPFSVSVSQLRALDGGNKHFLR (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHFLR

SEQ ID NO: 340477 - protein, 22 aa, Artificial Sequence
  Description of Artificial Sequence: Synthetic peptide
  Seed: VPFSVSVSQLRALDGGNKHFLR (PMEL_HUMAN)
  Core: RALDGGNKH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLXALXGXNKXFLR

SEQ ID NO: 340478 - protein, 23 aa, Artificial Sequence
  Description of Artificial Sequence: Synthetic peptide
  Seed: VPFSVSVSQLRALDGGNKHFLRN (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHFLRN

SEQ ID NO: 340479 - protein, 23 aa, Artificial Sequence
  Description of Artificial Sequence: Synthetic peptide
  Seed: VPFSVSVSQLRALDGGNKHFLRN (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHFLRN

SEQ ID NO: 340480 - protein, 23 aa, Artificial Sequence
  Description of Artificial Sequence: Synthetic peptide
  Seed: VPFSVSVSQLRALDGGNKHFLRN (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHFLRN

SEQ ID NO: 340481 - protein, 23 aa, Artificial Sequence
  Description of Artificial Sequence: Synthetic peptide
  Seed: VPFSVSVSQLRALDGGNKHFLRN (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHFLRN

SEQ ID NO: 340482 - protein, 23 aa, Artificial Sequence
  Description of Artificial Sequence: Synthetic peptide
  Seed: VPFSVSVSQLRALDGGNKHFLRN (PMEL_HUMAN)
  Core: RALDGGNKH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLXALXGXNKXFLRN

SEQ ID NO: 340483 - protein, 24 aa, Artificial Sequence
  Description of Artificial Sequence: Synthetic peptide
  Seed: VPFSVSVSQLRALDGGNKHFLRNQ (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHFLRNQ

SEQ ID NO: 340484 - protein, 24 aa, Artificial Sequence
  Description of Artificial Sequence: Synthetic peptide
  Seed: VPFSVSVSQLRALDGGNKHFLRNQ (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHFLRNQ

SEQ ID NO: 340485 - protein, 24 aa, Artificial Sequence
  Description of Artificial Sequence: Synthetic peptide
  Seed: VPFSVSVSQLRALDGGNKHFLRNQ (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHFLRNQ

SEQ ID NO: 340486 - protein, 24 aa, Artificial Sequence
  Description of Artificial Sequence: Synthetic peptide
  Seed: VPFSVSVSQLRALDGGNKHFLRNQ (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHFLRNQ

SEQ ID NO: 340487 - protein, 24 aa, Artificial Sequence
  Description of Artificial Sequence: Synthetic peptide
  Seed: VPFSVSVSQLRALDGGNKHFLRNQ (PMEL_HUMAN)
  Core: RALDGGNKH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLXALXGXNKXFLRNQ

SEQ ID NO: 340488 - protein, 24 aa, Artificial Sequence
  Description of Artificial Sequence: Synthetic peptide
  Seed: VPFSVSVSQLRALDGGNKHFLRNQ (PMEL_HUMAN)
  Core: LDGGNKHFL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLRAXDGXNXHFXRNQ

SEQ ID NO: 340489 - protein, 25 aa, Artificial Sequence
  Description of Artificial Sequence: Synthetic peptide
  Seed: VPFSVSVSQLRALDGGNKHFLRNQP (PMEL_HUMAN)
  Core: FSVSVSQLR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSVXVXQLXALDGGNKHFLRNQP

SEQ ID NO: 340490 - protein, 25 aa, Artificial Sequence
  Description of Artificial Sequence: Synthetic peptide
  Seed: VPFSVSVSQLRALDGGNKHFLRNQP (PMEL_HUMAN)
  Core: VSVSQLRAL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPFSXSVXQXRAXDGGNKHFLRNQP

SEQ ID NO: 340491 - protein, 25 aa, Artificial Sequence
  Description of Artificial Sequence: Synthetic peptide
  Seed: VPFSVSVSQLRALDGGNKHFLRNQP (PMEL_HUMAN)
  Core: VSQLRALDG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSXSQXRXLDXGNKHFLRNQP

SEQ ID NO: 340492 - protein, 25 aa, Artificial Sequence
  Description of Artificial Sequence: Synthetic peptide
  Seed: VPFSVSVSQLRALDGGNKHFLRNQP (PMEL_HUMAN)
  Core: LRALDGGNK
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQXRAXDXGNXHFLRNQP

SEQ ID NO: 340493 - protein, 25 aa, Artificial Sequence
  Description of Artificial Sequence: Synthetic peptide
  Seed: VPFSVSVSQLRALDGGNKHFLRNQP (PMEL_HUMAN)
  Core: RALDGGNKH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLXALXGXNKXFLRNQP

SEQ ID NO: 340494 - protein, 25 aa, Artificial Sequence
  Description of Artificial Sequence: Synthetic peptide
  Seed: VPFSVSVSQLRALDGGNKHFLRNQP (PMEL_HUMAN)
  Core: LDGGNKHFL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPFSVSVSQLRAXDGXNXHFXRNQP

SEQ ID NO: 340495 - protein, 25 aa, Artificial Sequence
  Description of Artificial Sequence: Synthetic peptide
  Seed: VPGTTDGHRPTAEAPNTTAGQVPTT (PMEL_HUMAN)
  Core: PTAEAPNTT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPGTTDGHRXTAXAXNTXAGQVPTT

SEQ ID NO: 340496 - protein, 13 aa, Artificial Sequence
  Description of Artificial Sequence: Synthetic peptide
  Seed: VPLAHSSSAFTIT (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXT

SEQ ID NO: 340497 - protein, 14 aa, Artificial Sequence
  Description of Artificial Sequence: Synthetic peptide
  Seed: VPLAHSSSAFTITD (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITD

SEQ ID NO: 340498 - protein, 14 aa, Artificial Sequence
  Description of Artificial Sequence: Synthetic peptide
  Seed: VPLAHSSSAFTITD (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTD

SEQ ID NO: 340499 - protein, 15 aa, Artificial Sequence
  Description of Artificial Sequence: Synthetic peptide
  Seed: VPLAHSSSAFTITDQ (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITDQ

SEQ ID NO: 340500 - protein, 15 aa, Artificial Sequence
  Description of Artificial Sequence: Synthetic peptide
  Seed: VPLAHSSSAFTITDQ (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQ

SEQ ID NO: 340501 - protein, 16 aa, Artificial Sequence
  Description of Artificial Sequence: Synthetic peptide
  Seed: VPLAHSSSAFTITDQV (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITDQV

SEQ ID NO: 340502 - protein, 16 aa, Artificial Sequence
  Description of Artificial Sequence: Synthetic peptide
  Seed: VPLAHSSSAFTITDQV (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQV

SEQ ID NO: 340503 - protein, 16 aa, Artificial Sequence
  Description of Artificial Sequence: Synthetic peptide
  Seed: VPLAHSSSAFTITDQV (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXV

SEQ ID NO: 340504 - protein, 17 aa, Artificial Sequence
  Description of Artificial Sequence: Synthetic peptide
  Seed: VPLAHSSSAFTITDQVP (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITDQVP

SEQ ID NO: 340505 - protein, 17 aa, Artificial Sequence
  Description of Artificial Sequence: Synthetic peptide
  Seed: VPLAHSSSAFTITDQVP (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVP

SEQ ID NO: 340506 - protein, 17 aa, Artificial Sequence
  Description of Artificial Sequence: Synthetic peptide
  Seed: VPLAHSSSAFTITDQVP (PMEL_HUMAN)
  Core: SSSAFTITD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHXSSXFXITXQVP

SEQ ID NO: 340507 - protein, 17 aa, Artificial Sequence
  Description of Artificial Sequence: Synthetic peptide
  Seed: VPLAHSSSAFTITDQVP (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVP

SEQ ID NO: 340508 - protein, 17 aa, Artificial Sequence
  Description of Artificial Sequence: Synthetic peptide
  Seed: VPLAHSSSAFTITDQVP (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXP

SEQ ID NO: 340509 - protein, 18 aa, Artificial Sequence
  Description of Artificial Sequence: Synthetic peptide
  Seed: VPLAHSSSAFTITDQVPF (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPF

SEQ ID NO: 340510 - protein, 18 aa, Artificial Sequence
  Description of Artificial Sequence: Synthetic peptide
  Seed: VPLAHSSSAFTITDQVPF (PMEL_HUMAN)
  Core: SSSAFTITD
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHXSSXFXITXQVPF

SEQ ID NO: 340511 - protein, 18 aa, Artificial Sequence
  Description of Artificial Sequence: Synthetic peptide
  Seed: VPLAHSSSAFTITDQVPF (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPF

SEQ ID NO: 340512 - protein, 19 aa, Artificial Sequence
  Description of Artificial Sequence: Synthetic peptide
  Seed: VPLAHSSSAFTITDQVPFS (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITDQVPFS

SEQ ID NO: 340513 - protein, 19 aa, Artificial Sequence
  Description of Artificial Sequence: Synthetic peptide
  Seed: VPLAHSSSAFTITDQVPFS (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFS

SEQ ID NO: 340514 - protein, 19 aa, Artificial Sequence
  Description of Artificial Sequence: Synthetic peptide
  Seed: VPLAHSSSAFTITDQVPFS (PMEL_HUMAN)
  Core: HSSSAFTIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLAXSSXAXTIXDQVPFS

SEQ ID NO: 340515 - protein, 19 aa, Artificial Sequence
  Description of Artificial Sequence: Synthetic peptide
  Seed: VPLAHSSSAFTITDQVPFS (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFS

SEQ ID NO: 340516 - protein, 19 aa, Artificial Sequence
  Description of Artificial Sequence: Synthetic peptide
  Seed: VPLAHSSSAFTITDQVPFS (PMEL_HUMAN)
  Core: AFTITDQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSXFTXTXQVXFS

SEQ ID NO: 340517 - protein, 19 aa, Artificial Sequence
  Description of Artificial Sequence: Synthetic peptide
  Seed: VPLAHSSSAFTITDQVPFS (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXS

SEQ ID NO: 340518 - protein, 20 aa, Artificial Sequence
  Description of Artificial Sequence: Synthetic peptide
  Seed: VPLAHSSSAFTITDQVPFSV (PMEL_HUMAN)
  Core: LAHSSSAFT
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXAHXSXAFXITDQVPFSV

SEQ ID NO: 340519 - protein, 20 aa, Artificial Sequence
  Description of Artificial Sequence: Synthetic peptide
  Seed: VPLAHSSSAFTITDQVPFSV (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSV

SEQ ID NO: 340520 - protein, 20 aa, Artificial Sequence
  Description of Artificial Sequence: Synthetic peptide
  Seed: VPLAHSSSAFTITDQVPFSV (PMEL_HUMAN)
  Core: HSSSAFTIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLAXSSXAXTIXDQVPFSV

SEQ ID NO: 340521 - protein, 20 aa, Artificial Sequence
  Description of Artificial Sequence: Synthetic peptide
  Seed: VPLAHSSSAFTITDQVPFSV (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVPFSV

SEQ ID NO: 340522 - protein, 20 aa, Artificial Sequence
  Description of Artificial Sequence: Synthetic peptide
  Seed: VPLAHSSSAFTITDQVPFSV (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSV

SEQ ID NO: 340523 - protein, 20 aa, Artificial Sequence
  Description of Artificial Sequence: Synthetic peptide
  Seed: VPLAHSSSAFTITDQVPFSV (PMEL_HUMAN)
  Core: AFTITDQVP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSXFTXTXQVXFSV

SEQ ID NO: 340524 - protein, 20 aa, Artificial Sequence
  Description of Artificial Sequence: Synthetic peptide
  Seed: VPLAHSSSAFTITDQVPFSV (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSV

SEQ ID NO: 340525 - protein, 21 aa, Artificial Sequence
  Description of Artificial Sequence: Synthetic peptide
  Seed: VPLAHSSSAFTITDQVPFSVS (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSVS

SEQ ID NO: 340526 - protein, 21 aa, Artificial Sequence
  Description of Artificial Sequence: Synthetic peptide
  Seed: VPLAHSSSAFTITDQVPFSVS (PMEL_HUMAN)
  Core: HSSSAFTIT
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLAXSSXAXTIXDQVPFSVS

SEQ ID NO: 340527 - protein, 21 aa, Artificial Sequence
  Description of Artificial Sequence: Synthetic peptide
  Seed: VPLAHSSSAFTITDQVPFSVS (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVPFSVS

SEQ ID NO: 340528 - protein, 21 aa, Artificial Sequence
  Description of Artificial Sequence: Synthetic peptide
  Seed: VPLAHSSSAFTITDQVPFSVS (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSVS

SEQ ID NO: 340529 - protein, 21 aa, Artificial Sequence
  Description of Artificial Sequence: Synthetic peptide
  Seed: VPLAHSSSAFTITDQVPFSVS (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSVS

SEQ ID NO: 340530 - protein, 22 aa, Artificial Sequence
  Description of Artificial Sequence: Synthetic peptide
  Seed: VPLAHSSSAFTITDQVPFSVSV (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSVSV

SEQ ID NO: 340531 - protein, 22 aa, Artificial Sequence
  Description of Artificial Sequence: Synthetic peptide
  Seed: VPLAHSSSAFTITDQVPFSVSV (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVPFSVSV

SEQ ID NO: 340532 - protein, 22 aa, Artificial Sequence
  Description of Artificial Sequence: Synthetic peptide
  Seed: VPLAHSSSAFTITDQVPFSVSV (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSVSV

SEQ ID NO: 340533 - protein, 22 aa, Artificial Sequence
  Description of Artificial Sequence: Synthetic peptide
  Seed: VPLAHSSSAFTITDQVPFSVSV (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSVSV

SEQ ID NO: 340534 - protein, 23 aa, Artificial Sequence
  Description of Artificial Sequence: Synthetic peptide
  Seed: VPLAHSSSAFTITDQVPFSVSVS (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSVSVS

SEQ ID NO: 340535 - protein, 23 aa, Artificial Sequence
  Description of Artificial Sequence: Synthetic peptide
  Seed: VPLAHSSSAFTITDQVPFSVSVS (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVPFSVSVS

SEQ ID NO: 340536 - protein, 23 aa, Artificial Sequence
  Description of Artificial Sequence: Synthetic peptide
  Seed: VPLAHSSSAFTITDQVPFSVSVS (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSVSVS

SEQ ID NO: 340537 - protein, 23 aa, Artificial Sequence
  Description of Artificial Sequence: Synthetic peptide
  Seed: VPLAHSSSAFTITDQVPFSVSVS (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSVSVS

SEQ ID NO: 340538 - protein, 23 aa, Artificial Sequence
  Description of Artificial Sequence: Synthetic peptide
  Seed: VPLAHSSSAFTITDQVPFSVSVS (PMEL_HUMAN)
  Core: ITDQVPFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAFTXTDXVXFSXSVS

SEQ ID NO: 340539 - protein, 24 aa, Artificial Sequence
  Description of Artificial Sequence: Synthetic peptide
  Seed: VPLAHSSSAFTITDQVPFSVSVSQ (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSVSVSQ

SEQ ID NO: 340540 - protein, 24 aa, Artificial Sequence
  Description of Artificial Sequence: Synthetic peptide
  Seed: VPLAHSSSAFTITDQVPFSVSVSQ (PMEL_HUMAN)
  Core: SSAFTITDQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSXSAXTXTDXVPFSVSVSQ

SEQ ID NO: 340541 - protein, 24 aa, Artificial Sequence
  Description of Artificial Sequence: Synthetic peptide
  Seed: VPLAHSSSAFTITDQVPFSVSVSQ (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSVSVSQ

SEQ ID NO: 340542 - protein, 24 aa, Artificial Sequence
  Description of Artificial Sequence: Synthetic peptide
  Seed: VPLAHSSSAFTITDQVPFSVSVSQ (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSVSVSQ

SEQ ID NO: 340543 - protein, 24 aa, Artificial Sequence
  Description of Artificial Sequence: Synthetic peptide
  Seed: VPLAHSSSAFTITDQVPFSVSVSQ (PMEL_HUMAN)
  Core: ITDQVPFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAFTXTDXVXFSXSVSQ

SEQ ID NO: 340544 - protein, 25 aa, Artificial Sequence
  Description of Artificial Sequence: Synthetic peptide
  Seed: VPLAHSSSAFTITDQVPFSVSVSQL (PMEL_HUMAN)
  Core: AHSSSAFTI
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXHSXSXFTXTDQVPFSVSVSQL

SEQ ID NO: 340545 - protein, 25 aa, Artificial Sequence
  Description of Artificial Sequence: Synthetic peptide
  Seed: VPLAHSSSAFTITDQVPFSVSVSQL (PMEL_HUMAN)
  Core: SAFTITDQV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSXAFXIXDQXPFSVSVSQL

SEQ ID NO: 340546 - protein, 25 aa, Artificial Sequence
  Description of Artificial Sequence: Synthetic peptide
  Seed: VPLAHSSSAFTITDQVPFSVSVSQL (PMEL_HUMAN)
  Core: FTITDQVPF
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAXTIXDXVPXSVSVSQL

SEQ ID NO: 340547 - protein, 25 aa, Artificial Sequence
  Description of Artificial Sequence: Synthetic peptide
  Seed: VPLAHSSSAFTITDQVPFSVSVSQL (PMEL_HUMAN)
  Core: ITDQVPFSV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAFTXTDXVXFSXSVSQL

SEQ ID NO: 340548 - protein, 25 aa, Artificial Sequence
  Description of Artificial Sequence: Synthetic peptide
  Seed: VPLAHSSSAFTITDQVPFSVSVSQL (PMEL_HUMAN)
  Core: QVPFSVSVS
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAFTITDXVPXSXSVXQL

SEQ ID NO: 340549 - protein, 25 aa, Artificial Sequence
  Description of Artificial Sequence: Synthetic peptide
  Seed: VPLAHSSSAFTITDQVPFSVSVSQL (PMEL_HUMAN)
  Core: PFSVSVSQL
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (25)..(25): Xaa can be Ala, Cys, Asp, Glu, Phe, Gly, His, Ile, Lys, Leu, Met, Asn, Pro, Gln, Arg, Ser, Thr, Val, Trp, or Tyr
VPLAHSSSAFTITDQVXFSXSXSQX

SEQ ID NO: 340550 - protein, 14 aa, Artificial Sequence
  Description of Artificial Sequence: Synthetic peptide
  Seed: VPLDCVLYRYGSFS (PMEL_HUMAN)
  Core: LDCVLYRYG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXDCXLXRYXSFS

SEQ ID NO: 340551 - protein, 15 aa, Artificial Sequence
  Description of Artificial Sequence: Synthetic peptide
  Seed: VPLDCVLYRYGSFSV (PMEL_HUMAN)
  Core: LDCVLYRYG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXDCXLXRYXSFSV

SEQ ID NO: 340552 - protein, 15 aa, Artificial Sequence
  Description of Artificial Sequence: Synthetic peptide
  Seed: VPLDCVLYRYGSFSV (PMEL_HUMAN)
  Core: DCVLYRYGS
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXCVXYXYGXFSV

SEQ ID NO: 340553 - protein, 15 aa, Artificial Sequence
  Description of Artificial Sequence: Synthetic peptide
  Seed: VPLDCVLYRYGSFSV (PMEL_HUMAN)
  Core: CVLYRYGSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLDXVLXRXGSXSV

SEQ ID NO: 340554 - protein, 15 aa, Artificial Sequence
  Description of Artificial Sequence: Synthetic peptide
  Seed: VPLDCVLYRYGSFSV (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSX

SEQ ID NO: 340555 - protein, 16 aa, Artificial Sequence
  Description of Artificial Sequence: Synthetic peptide
  Seed: VPLDCVLYRYGSFSVT (PMEL_HUMAN)
  Core: LDCVLYRYG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXDCXLXRYXSFSVT

SEQ ID NO: 340556 - protein, 16 aa, Artificial Sequence
  Description of Artificial Sequence: Synthetic peptide
  Seed: VPLDCVLYRYGSFSVT (PMEL_HUMAN)
  Core: CVLYRYGSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLDXVLXRXGSXSVT

SEQ ID NO: 340557 - protein, 16 aa, Artificial Sequence
  Description of Artificial Sequence: Synthetic peptide
  Seed: VPLDCVLYRYGSFSVT (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXT

SEQ ID NO: 340558 - protein, 16 aa, Artificial Sequence
  Description of Artificial Sequence: Synthetic peptide
  Seed: VPLDCVLYRYGSFSVT (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVX

SEQ ID NO: 340559 - protein, 17 aa, Artificial Sequence
  Description of Artificial Sequence: Synthetic peptide
  Seed: VPLDCVLYRYGSFSVTL (PMEL_HUMAN)
  Core: LDCVLYRYG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXDCXLXRYXSFSVTL

SEQ ID NO: 340560 - protein, 17 aa, Artificial Sequence
  Description of Artificial Sequence: Synthetic peptide
  Seed: VPLDCVLYRYGSFSVTL (PMEL_HUMAN)
  Core: CVLYRYGSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLDXVLXRXGSXSVTL

SEQ ID NO: 340561 - protein, 17 aa, Artificial Sequence
  Description of Artificial Sequence: Synthetic peptide
  Seed: VPLDCVLYRYGSFSVTL (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTL

SEQ ID NO: 340562 - protein, 17 aa, Artificial Sequence
  Description of Artificial Sequence: Synthetic peptide
  Seed: VPLDCVLYRYGSFSVTL (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXL

SEQ ID NO: 340563 - protein, 17 aa, Artificial Sequence
  Description of Artificial Sequence: Synthetic peptide
  Seed: VPLDCVLYRYGSFSVTL (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTX

SEQ ID NO: 340564 - protein, 18 aa, Artificial Sequence
  Description of Artificial Sequence: Synthetic peptide
  Seed: VPLDCVLYRYGSFSVTLD (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLD

SEQ ID NO: 340565 - protein, 18 aa, Artificial Sequence
  Description of Artificial Sequence: Synthetic peptide
  Seed: VPLDCVLYRYGSFSVTLD (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLD

SEQ ID NO: 340566 - protein, 19 aa, Artificial Sequence
  Description of Artificial Sequence: Synthetic peptide
  Seed: VPLDCVLYRYGSFSVTLDI (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDI

SEQ ID NO: 340567 - protein, 19 aa, Artificial Sequence
  Description of Artificial Sequence: Synthetic peptide
  Seed: VPLDCVLYRYGSFSVTLDI (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDI

SEQ ID NO: 340568 - protein, 19 aa, Artificial Sequence
  Description of Artificial Sequence: Synthetic peptide
  Seed: VPLDCVLYRYGSFSVTLDI (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDI

SEQ ID NO: 340569 - protein, 19 aa, Artificial Sequence
  Description of Artificial Sequence: Synthetic peptide
  Seed: VPLDCVLYRYGSFSVTLDI (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXI

SEQ ID NO: 340570 - protein, 20 aa, Artificial Sequence
  Description of Artificial Sequence: Synthetic peptide
  Seed: VPLDCVLYRYGSFSVTLDIV (PMEL_HUMAN)
  Core: CVLYRYGSF
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPLDXVLXRXGSXSVTLDIV

SEQ ID NO: 340571 - protein, 20 aa, Artificial Sequence
  Description of Artificial Sequence: Synthetic peptide
  Seed: VPLDCVLYRYGSFSVTLDIV (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIV

SEQ ID NO: 340572 - protein, 20 aa, Artificial Sequence
  Description of Artificial Sequence: Synthetic peptide
  Seed: VPLDCVLYRYGSFSVTLDIV (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIV

SEQ ID NO: 340573 - protein, 20 aa, Artificial Sequence
  Description of Artificial Sequence: Synthetic peptide
  Seed: VPLDCVLYRYGSFSVTLDIV (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIV

SEQ ID NO: 340574 - protein, 20 aa, Artificial Sequence
  Description of Artificial Sequence: Synthetic peptide
  Seed: VPLDCVLYRYGSFSVTLDIV (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIV

SEQ ID NO: 340575 - protein, 21 aa, Artificial Sequence
  Description of Artificial Sequence: Synthetic peptide
  Seed: VPLDCVLYRYGSFSVTLDIVQ (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIVQ

SEQ ID NO: 340576 - protein, 21 aa, Artificial Sequence
  Description of Artificial Sequence: Synthetic peptide
  Seed: VPLDCVLYRYGSFSVTLDIVQ (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIVQ

SEQ ID NO: 340577 - protein, 21 aa, Artificial Sequence
  Description of Artificial Sequence: Synthetic peptide
  Seed: VPLDCVLYRYGSFSVTLDIVQ (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIVQ

SEQ ID NO: 340578 - protein, 21 aa, Artificial Sequence
  Description of Artificial Sequence: Synthetic peptide
  Seed: VPLDCVLYRYGSFSVTLDIVQ (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIVQ

SEQ ID NO: 340579 - protein, 21 aa, Artificial Sequence
  Description of Artificial Sequence: Synthetic peptide
  Seed: VPLDCVLYRYGSFSVTLDIVQ (PMEL_HUMAN)
  Core: SFSVTLDIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGXFSXTXDIXQ

SEQ ID NO: 340580 - protein, 22 aa, Artificial Sequence
  Description of Artificial Sequence: Synthetic peptide
  Seed: VPLDCVLYRYGSFSVTLDIVQG (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIVQG

SEQ ID NO: 340581 - protein, 22 aa, Artificial Sequence
  Description of Artificial Sequence: Synthetic peptide
  Seed: VPLDCVLYRYGSFSVTLDIVQG (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIVQG

SEQ ID NO: 340582 - protein, 22 aa, Artificial Sequence
  Description of Artificial Sequence: Synthetic peptide
  Seed: VPLDCVLYRYGSFSVTLDIVQG (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIVQG

SEQ ID NO: 340583 - protein, 22 aa, Artificial Sequence
  Description of Artificial Sequence: Synthetic peptide
  Seed: VPLDCVLYRYGSFSVTLDIVQG (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIVQG

SEQ ID NO: 340584 - protein, 22 aa, Artificial Sequence
  Description of Artificial Sequence: Synthetic peptide
  Seed: VPLDCVLYRYGSFSVTLDIVQG (PMEL_HUMAN)
  Core: SFSVTLDIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGXFSXTXDIXQG

SEQ ID NO: 340585 - protein, 23 aa, Artificial Sequence
  Description of Artificial Sequence: Synthetic peptide
  Seed: VPLDCVLYRYGSFSVTLDIVQGI (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIVQGI

SEQ ID NO: 340586 - protein, 23 aa, Artificial Sequence
  Description of Artificial Sequence: Synthetic peptide
  Seed: VPLDCVLYRYGSFSVTLDIVQGI (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIVQGI

SEQ ID NO: 340587 - protein, 23 aa, Artificial Sequence
  Description of Artificial Sequence: Synthetic peptide
  Seed: VPLDCVLYRYGSFSVTLDIVQGI (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIVQGI

SEQ ID NO: 340588 - protein, 23 aa, Artificial Sequence
  Description of Artificial Sequence: Synthetic peptide
  Seed: VPLDCVLYRYGSFSVTLDIVQGI (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIVQGI

SEQ ID NO: 340589 - protein, 23 aa, Artificial Sequence
  Description of Artificial Sequence: Synthetic peptide
  Seed: VPLDCVLYRYGSFSVTLDIVQGI (PMEL_HUMAN)
  Core: SFSVTLDIV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGXFSXTXDIXQGI

SEQ ID NO: 340590 - protein, 24 aa, Artificial Sequence
  Description of Artificial Sequence: Synthetic peptide
  Seed: VPLDCVLYRYGSFSVTLDIVQGIE (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIVQGIE

SEQ ID NO: 340591 - protein, 24 aa, Artificial Sequence
  Description of Artificial Sequence: Synthetic peptide
  Seed: VPLDCVLYRYGSFSVTLDIVQGIE (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIVQGIE

SEQ ID NO: 340592 - protein, 24 aa, Artificial Sequence
  Description of Artificial Sequence: Synthetic peptide
  Seed: VPLDCVLYRYGSFSVTLDIVQGIE (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIVQGIE

SEQ ID NO: 340593 - protein, 24 aa, Artificial Sequence
  Description of Artificial Sequence: Synthetic peptide
  Seed: VPLDCVLYRYGSFSVTLDIVQGIE (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIVQGIE

SEQ ID NO: 340594 - protein, 24 aa, Artificial Sequence
  Description of Artificial Sequence: Synthetic peptide
  Seed: VPLDCVLYRYGSFSVTLDIVQGIE (PMEL_HUMAN)
  Core: FSVTLDIVQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGSXSVXLXIVXGIE

SEQ ID NO: 340595 - protein, 25 aa, Artificial Sequence
  Description of Artificial Sequence: Synthetic peptide
  Seed: VPLDCVLYRYGSFSVTLDIVQGIES (PMEL_HUMAN)
  Core: LYRYGSFSV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVXYRXGXFSXTLDIVQGIES

SEQ ID NO: 340596 - protein, 25 aa, Artificial Sequence
  Description of Artificial Sequence: Synthetic peptide
  Seed: VPLDCVLYRYGSFSVTLDIVQGIES (PMEL_HUMAN)
  Core: YRYGSFSVT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLXRYXSXSVXLDIVQGIES

SEQ ID NO: 340597 - protein, 25 aa, Artificial Sequence
  Description of Artificial Sequence: Synthetic peptide
  Seed: VPLDCVLYRYGSFSVTLDIVQGIES (PMEL_HUMAN)
  Core: RYGSFSVTL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYXYGXFXVTXDIVQGIES

SEQ ID NO: 340598 - protein, 25 aa, Artificial Sequence
  Description of Artificial Sequence: Synthetic peptide
  Seed: VPLDCVLYRYGSFSVTLDIVQGIES (PMEL_HUMAN)
  Core: YGSFSVTLD
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRXGSXSXTLXIVQGIES

SEQ ID NO: 340599 - protein, 25 aa, Artificial Sequence
  Description of Artificial Sequence: Synthetic peptide
  Seed: VPLDCVLYRYGSFSVTLDIVQGIES (PMEL_HUMAN)
  Core: FSVTLDIVQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGSXSVXLXIVXGIES

SEQ ID NO: 340600 - protein, 25 aa, Artificial Sequence
  Description of Artificial Sequence: Synthetic peptide
  Seed: VPLDCVLYRYGSFSVTLDIVQGIES (PMEL_HUMAN)
  Core: VTLDIVQGI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPLDCVLYRYGSFSXTLXIXQGXES

SEQ ID NO: 340601 - protein, 15 aa, Artificial Sequence
  Description of Artificial Sequence: Synthetic peptide
  Seed: VPLIVGILLVLMAVV (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVV

SEQ ID NO: 340602 - protein, 16 aa, Artificial Sequence
  Description of Artificial Sequence: Synthetic peptide
  Seed: VPLIVGILLVLMAVVL (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVL

SEQ ID NO: 340603 - protein, 17 aa, Artificial Sequence
  Description of Artificial Sequence: Synthetic peptide
  Seed: VPLIVGILLVLMAVVLA (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVLA

SEQ ID NO: 340604 - protein, 17 aa, Artificial Sequence
  Description of Artificial Sequence: Synthetic peptide
  Seed: VPLIVGILLVLMAVVLA (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLA

SEQ ID NO: 340605 - protein, 17 aa, Artificial Sequence
  Description of Artificial Sequence: Synthetic peptide
  Seed: VPLIVGILLVLMAVVLA (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXA

SEQ ID NO: 340606 - protein, 18 aa, Artificial Sequence
  Description of Artificial Sequence: Synthetic peptide
  Seed: VPLIVGILLVLMAVVLAS (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXAS

SEQ ID NO: 340607 - protein, 19 aa, Artificial Sequence
  Description of Artificial Sequence: Synthetic peptide
  Seed: VPLIVGILLVLMAVVLASL (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVLASL

SEQ ID NO: 340608 - protein, 19 aa, Artificial Sequence
  Description of Artificial Sequence: Synthetic peptide
  Seed: VPLIVGILLVLMAVVLASL (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLASL

SEQ ID NO: 340609 - protein, 19 aa, Artificial Sequence
  Description of Artificial Sequence: Synthetic peptide
  Seed: VPLIVGILLVLMAVVLASL (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASL

SEQ ID NO: 340610 - protein, 19 aa, Artificial Sequence
  Description of Artificial Sequence: Synthetic peptide
  Seed: VPLIVGILLVLMAVVLASL (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSL

SEQ ID NO: 340611 - protein, 20 aa, Artificial Sequence
  Description of Artificial Sequence: Synthetic peptide
  Seed: VPLIVGILLVLMAVVLASLI (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVLASLI

SEQ ID NO: 340612 - protein, 20 aa, Artificial Sequence
  Description of Artificial Sequence: Synthetic peptide
  Seed: VPLIVGILLVLMAVVLASLI (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLASLI

SEQ ID NO: 340613 - protein, 20 aa, Artificial Sequence
  Description of Artificial Sequence: Synthetic peptide
  Seed: VPLIVGILLVLMAVVLASLI (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLI

SEQ ID NO: 340614 - protein, 20 aa, Artificial Sequence
  Description of Artificial Sequence: Synthetic peptide
  Seed: VPLIVGILLVLMAVVLASLI (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSLI

SEQ ID NO: 340615 - protein, 21 aa, Artificial Sequence
  Description of Artificial Sequence: Synthetic peptide
  Seed: VPLIVGILLVLMAVVLASLIY (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLASLIY

SEQ ID NO: 340616 - protein, 21 aa, Artificial Sequence
  Description of Artificial Sequence: Synthetic peptide
  Seed: VPLIVGILLVLMAVVLASLIY (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLIY

SEQ ID NO: 340617 - protein, 21 aa, Artificial Sequence
  Description of Artificial Sequence: Synthetic peptide
  Seed: VPLIVGILLVLMAVVLASLIY (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSLIY

SEQ ID NO: 340618 - protein, 22 aa, Artificial Sequence
  Description of Artificial Sequence: Synthetic peptide
  Seed: VPLIVGILLVLMAVVLASLIYR (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVLASLIYR

SEQ ID NO: 340619 - protein, 22 aa, Artificial Sequence
  Description of Artificial Sequence: Synthetic peptide
  Seed: VPLIVGILLVLMAVVLASLIYR (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLASLIYR

SEQ ID NO: 340620 - protein, 22 aa, Artificial Sequence
  Description of Artificial Sequence: Synthetic peptide
  Seed: VPLIVGILLVLMAVVLASLIYR (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLIYR

SEQ ID NO: 340621 - protein, 22 aa, Artificial Sequence
  Description of Artificial Sequence: Synthetic peptide
  Seed: VPLIVGILLVLMAVVLASLIYR (PMEL_HUMAN)
  Core: VLMAVVLAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLXLMXVXLAXLIYR

SEQ ID NO: 340622 - protein, 22 aa, Artificial Sequence
  Description of Artificial Sequence: Synthetic peptide
  Seed: VPLIVGILLVLMAVVLASLIYR (PMEL_HUMAN)
  Core: LMAVVLASL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVXMAXVXASXIYR

SEQ ID NO: 340623 - protein, 23 aa, Artificial Sequence
  Description of Artificial Sequence: Synthetic peptide
  Seed: VPLIVGILLVLMAVVLASLIYRR (PMEL_HUMAN)
  Core: IVGILLVLM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPLXVGXLXVLXAVVLASLIYRR

SEQ ID NO: 340624 - protein, 23 aa, Artificial Sequence
  Description of Artificial Sequence: Synthetic peptide
  Seed: VPLIVGILLVLMAVVLASLIYRR (PMEL_HUMAN)
  Core: ILLVLMAVV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGXLLXLXAVXLASLIYRR

SEQ ID NO: 340625 - protein, 23 aa, Artificial Sequence
  Description of Artificial Sequence: Synthetic peptide
  Seed: VPLIVGILLVLMAVVLASLIYRR (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLIYRR

SEQ ID NO: 340626 - protein, 23 aa, Artificial Sequence
  Description of Artificial Sequence: Synthetic peptide
  Seed: VPLIVGILLVLMAVVLASLIYRR (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSLIYRR

SEQ ID NO: 340627 - protein, 23 aa, Artificial Sequence
  Description of Artificial Sequence: Synthetic peptide
  Seed: VPLIVGILLVLMAVVLASLIYRR (PMEL_HUMAN)
  Core: VLMAVVLAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLXLMXVXLAXLIYRR

SEQ ID NO: 340628 - protein, 23 aa, Artificial Sequence
  Description of Artificial Sequence: Synthetic peptide
  Seed: VPLIVGILLVLMAVVLASLIYRR (PMEL_HUMAN)
  Core: LMAVVLASL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVXMAXVXASXIYRR

SEQ ID NO: 340629 - protein, 23 aa, Artificial Sequence
  Description of Artificial Sequence: Synthetic peptide
  Seed: VPLIVGILLVLMAVVLASLIYRR (PMEL_HUMAN)
  Core: MAVVLASLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLXAVXLXSLXYRR

SEQ ID NO: 340630 - protein, 23 aa, Artificial Sequence
  Description of Artificial Sequence: Synthetic peptide
  Seed: VPLIVGILLVLMAVVLASLIYRR (PMEL_HUMAN)
  Core: VVLASLIYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAXVLXSXIYXR

SEQ ID NO: 340631 - protein, 24 aa, Artificial Sequence
  Description of Artificial Sequence: Synthetic peptide
  Seed: VPLIVGILLVLMAVVLASLIYRRR (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLIYRRR

SEQ ID NO: 340632 - protein, 24 aa, Artificial Sequence
  Description of Artificial Sequence: Synthetic peptide
  Seed: VPLIVGILLVLMAVVLASLIYRRR (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSLIYRRR

SEQ ID NO: 340633 - protein, 24 aa, Artificial Sequence
  Description of Artificial Sequence: Synthetic peptide
  Seed: VPLIVGILLVLMAVVLASLIYRRR (PMEL_HUMAN)
  Core: VLMAVVLAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLXLMXVXLAXLIYRRR

SEQ ID NO: 340634 - protein, 24 aa, Artificial Sequence
  Description of Artificial Sequence: Synthetic peptide
  Seed: VPLIVGILLVLMAVVLASLIYRRR (PMEL_HUMAN)
  Core: MAVVLASLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLXAVXLXSLXYRRR

SEQ ID NO: 340635 - protein, 24 aa, Artificial Sequence
  Description of Artificial Sequence: Synthetic peptide
  Seed: VPLIVGILLVLMAVVLASLIYRRR (PMEL_HUMAN)
  Core: AVVLASLIY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMXVVXAXLIXRRR

SEQ ID NO: 340636 - protein, 24 aa, Artificial Sequence
  Description of Artificial Sequence: Synthetic peptide
  Seed: VPLIVGILLVLMAVVLASLIYRRR (PMEL_HUMAN)
  Core: VVLASLIYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAXVLXSXIYXRR

SEQ ID NO: 340637 - protein, 24 aa, Artificial Sequence
  Description of Artificial Sequence: Synthetic peptide
  Seed: VPLIVGILLVLMAVVLASLIYRRR (PMEL_HUMAN)
  Core: VLASLIYRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAVXLAXLXYRXR

SEQ ID NO: 340638 - protein, 24 aa, Artificial Sequence
  Description of Artificial Sequence: Synthetic peptide
  Seed: VPLIVGILLVLMAVVLASLIYRRR (PMEL_HUMAN)
  Core: LASLIYRRR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAVVXASXIXRRX

SEQ ID NO: 340639 - protein, 25 aa, Artificial Sequence
  Description of Artificial Sequence: Synthetic peptide
  Seed: VPLIVGILLVLMAVVLASLIYRRRL (PMEL_HUMAN)
  Core: LLVLMAVVL
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGIXLVXMXVVXASLIYRRRL

SEQ ID NO: 340640 - protein, 25 aa, Artificial Sequence
  Description of Artificial Sequence: Synthetic peptide
  Seed: VPLIVGILLVLMAVVLASLIYRRRL (PMEL_HUMAN)
  Core: LVLMAVVLA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILXVLXAXVLXSLIYRRRL

SEQ ID NO: 340641 - protein, 25 aa, Artificial Sequence
  Description of Artificial Sequence: Synthetic peptide
  Seed: VPLIVGILLVLMAVVLASLIYRRRL (PMEL_HUMAN)
  Core: VLMAVVLAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLXLMXVXLAXLIYRRRL

SEQ ID NO: 340642 - protein, 25 aa, Artificial Sequence
  Description of Artificial Sequence: Synthetic peptide
  Seed: VPLIVGILLVLMAVVLASLIYRRRL (PMEL_HUMAN)
  Core: LMAVVLASL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVXMAXVXASXIYRRRL

SEQ ID NO: 340643 - protein, 25 aa, Artificial Sequence
  Description of Artificial Sequence: Synthetic peptide
  Seed: VPLIVGILLVLMAVVLASLIYRRRL (PMEL_HUMAN)
  Core: MAVVLASLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLXAVXLXSLXYRRRL

SEQ ID NO: 340644 - protein, 25 aa, Artificial Sequence
  Description of Artificial Sequence: Synthetic peptide
  Seed: VPLIVGILLVLMAVVLASLIYRRRL (PMEL_HUMAN)
  Core: AVVLASLIY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMXVVXAXLIXRRRL

SEQ ID NO: 340645 - protein, 25 aa, Artificial Sequence
  Description of Artificial Sequence: Synthetic peptide
  Seed: VPLIVGILLVLMAVVLASLIYRRRL (PMEL_HUMAN)
  Core: VVLASLIYR
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAXVLXSXIYXRRL

SEQ ID NO: 340646 - protein, 25 aa, Artificial Sequence
  Description of Artificial Sequence: Synthetic peptide
  Seed: VPLIVGILLVLMAVVLASLIYRRRL (PMEL_HUMAN)
  Core: VLASLIYRR
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAVXLAXLXYRXRL

SEQ ID NO: 340647 - protein, 25 aa, Artificial Sequence
  Description of Artificial Sequence: Synthetic peptide
  Seed: VPLIVGILLVLMAVVLASLIYRRRL (PMEL_HUMAN)
  Core: LASLIYRRR
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VPLIVGILLVLMAVVXASXIXRRXL

SEQ ID NO: 340648 - protein, 14 aa, Artificial Sequence
  Description of Artificial Sequence: Synthetic peptide
  Seed: VPQLPHSSSHWLRL (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRX

SEQ ID NO: 340649 - protein, 15 aa, Artificial Sequence
  Description of Artificial Sequence: Synthetic peptide
  Seed: VPQLPHSSSHWLRLP (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLP

SEQ ID NO: 340650 - protein, 15 aa, Artificial Sequence
  Description of Artificial Sequence: Synthetic peptide
  Seed: VPQLPHSSSHWLRLP (PMEL_HUMAN)
  Core: PHSSSHWLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPQLXHSXSXWLXLP

SEQ ID NO: 340651 - protein, 15 aa, Artificial Sequence
  Description of Artificial Sequence: Synthetic peptide
  Seed: VPQLPHSSSHWLRLP (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXP

SEQ ID NO: 340652 - protein, 16 aa, Artificial Sequence
  Description of Artificial Sequence: Synthetic peptide
  Seed: VPQLPHSSSHWLRLPR (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPR

SEQ ID NO: 340653 - protein, 17 aa, Artificial Sequence
  Description of Artificial Sequence: Synthetic peptide
  Seed: VPQLPHSSSHWLRLPRI (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRI

SEQ ID NO: 340654 - protein, 17 aa, Artificial Sequence
  Description of Artificial Sequence: Synthetic peptide
  Seed: VPQLPHSSSHWLRLPRI (PMEL_HUMAN)
  Core: PHSSSHWLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPQLXHSXSXWLXLPRI

SEQ ID NO: 340655 - protein, 17 aa, Artificial Sequence
  Description of Artificial Sequence: Synthetic peptide
  Seed: VPQLPHSSSHWLRLPRI (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRI

SEQ ID NO: 340656 - protein, 18 aa, Artificial Sequence
  Description of Artificial Sequence: Synthetic peptide
  Seed: VPQLPHSSSHWLRLPRIF (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIF

SEQ ID NO: 340657 - protein, 19 aa, Artificial Sequence
  Description of Artificial Sequence: Synthetic peptide
  Seed: VPQLPHSSSHWLRLPRIFC (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFC

SEQ ID NO: 340658 - protein, 20 aa, Artificial Sequence
  Description of Artificial Sequence: Synthetic peptide
  Seed: VPQLPHSSSHWLRLPRIFCS (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRIFCS

SEQ ID NO: 340659 - protein, 20 aa, Artificial Sequence
  Description of Artificial Sequence: Synthetic peptide
  Seed: VPQLPHSSSHWLRLPRIFCS (PMEL_HUMAN)
  Core: PHSSSHWLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPQLXHSXSXWLXLPRIFCS

SEQ ID NO: 340660 - protein, 20 aa, Artificial Sequence
  Description of Artificial Sequence: Synthetic peptide
  Seed: VPQLPHSSSHWLRLPRIFCS (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCS

SEQ ID NO: 340661 - protein, 20 aa, Artificial Sequence
  Description of Artificial Sequence: Synthetic peptide
  Seed: VPQLPHSSSHWLRLPRIFCS (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCS

SEQ ID NO: 340662 - protein, 20 aa, Artificial Sequence
  Description of Artificial Sequence: Synthetic peptide
  Seed: VPQLPHSSSHWLRLPRIFCS (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXS

SEQ ID NO: 340663 - protein, 21 aa, Artificial Sequence
  Description of Artificial Sequence: Synthetic peptide
  Seed: VPQLPHSSSHWLRLPRIFCSC (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRIFCSC

SEQ ID NO: 340664 - protein, 21 aa, Artificial Sequence
  Description of Artificial Sequence: Synthetic peptide
  Seed: VPQLPHSSSHWLRLPRIFCSC (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCSC

SEQ ID NO: 340665 - protein, 21 aa, Artificial Sequence
  Description of Artificial Sequence: Synthetic peptide
  Seed: VPQLPHSSSHWLRLPRIFCSC (PMEL_HUMAN)
  Core: SSHWLRLPR
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSXSHXLXLPXIFCSC

SEQ ID NO: 340666 - protein, 21 aa, Artificial Sequence
  Description of Artificial Sequence: Synthetic peptide
  Seed: VPQLPHSSSHWLRLPRIFCSC (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCSC

SEQ ID NO: 340667 - protein, 21 aa, Artificial Sequence
  Description of Artificial Sequence: Synthetic peptide
  Seed: VPQLPHSSSHWLRLPRIFCSC (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXSC

SEQ ID NO: 340668 - protein, 22 aa, Artificial Sequence
  Description of Artificial Sequence: Synthetic peptide
  Seed: VPQLPHSSSHWLRLPRIFCSCP (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRIFCSCP

SEQ ID NO: 340669 - protein, 22 aa, Artificial Sequence
  Description of Artificial Sequence: Synthetic peptide
  Seed: VPQLPHSSSHWLRLPRIFCSCP (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCSCP

SEQ ID NO: 340670 - protein, 22 aa, Artificial Sequence
  Description of Artificial Sequence: Synthetic peptide
  Seed: VPQLPHSSSHWLRLPRIFCSCP (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCSCP

SEQ ID NO: 340671 - protein, 22 aa, Artificial Sequence
  Description of Artificial Sequence: Synthetic peptide
  Seed: VPQLPHSSSHWLRLPRIFCSCP (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXSCP

SEQ ID NO: 340672 - protein, 23 aa, Artificial Sequence
  Description of Artificial Sequence: Synthetic peptide
  Seed: VPQLPHSSSHWLRLPRIFCSCPI (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRIFCSCPI

SEQ ID NO: 340673 - protein, 23 aa, Artificial Sequence
  Description of Artificial Sequence: Synthetic peptide
  Seed: VPQLPHSSSHWLRLPRIFCSCPI (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCSCPI

SEQ ID NO: 340674 - protein, 23 aa, Artificial Sequence
  Description of Artificial Sequence: Synthetic peptide
  Seed: VPQLPHSSSHWLRLPRIFCSCPI (PMEL_HUMAN)
  Core: SSSHWLRLP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHXSSXWXRLXRIFCSCPI

SEQ ID NO: 340675 - protein, 23 aa, Artificial Sequence
  Description of Artificial Sequence: Synthetic peptide
  Seed: VPQLPHSSSHWLRLPRIFCSCPI (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCSCPI

SEQ ID NO: 340676 - protein, 23 aa, Artificial Sequence
  Description of Artificial Sequence: Synthetic peptide
  Seed: VPQLPHSSSHWLRLPRIFCSCPI (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXSCPI

SEQ ID NO: 340677 - protein, 24 aa, Artificial Sequence
  Description of Artificial Sequence: Synthetic peptide
  Seed: VPQLPHSSSHWLRLPRIFCSCPIG (PMEL_HUMAN)
  Core: LPHSSSHWL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPQXPHXSXHWXRLPRIFCSCPIG

SEQ ID NO: 340678 - protein, 24 aa, Artificial Sequence
  Description of Artificial Sequence: Synthetic peptide
  Seed: VPQLPHSSSHWLRLPRIFCSCPIG (PMEL_HUMAN)
  Core: PHSSSHWLR
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPQLXHSXSXWLXLPRIFCSCPIG

SEQ ID NO: 340679 - protein, 24 aa, Artificial Sequence
  Description of Artificial Sequence: Synthetic peptide
  Seed: VPQLPHSSSHWLRLPRIFCSCPIG (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCSCPIG

SEQ ID NO: 340680 - protein, 24 aa, Artificial Sequence
  Description of Artificial Sequence: Synthetic peptide
  Seed: VPQLPHSSSHWLRLPRIFCSCPIG (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCSCPIG

SEQ ID NO: 340681 - protein, 24 aa, Artificial Sequence
  Description of Artificial Sequence: Synthetic peptide
  Seed: VPQLPHSSSHWLRLPRIFCSCPIG (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXSCPIG

SEQ ID NO: 340682 - protein, 24 aa, Artificial Sequence
  Description of Artificial Sequence: Synthetic peptide
  Seed: VPQLPHSSSHWLRLPRIFCSCPIG (PMEL_HUMAN)
  Core: PRIFCSCPI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHWLRLXRIXCXCPXG

SEQ ID NO: 340683 - protein, 25 aa, Artificial Sequence
  Description of Artificial Sequence: Synthetic peptide
  Seed: VPQLPHSSSHWLRLPRIFCSCPIGE (PMEL_HUMAN)
  Core: HSSSHWLRL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPXSSXHXLRXPRIFCSCPIGE

SEQ ID NO: 340684 - protein, 25 aa, Artificial Sequence
  Description of Artificial Sequence: Synthetic peptide
  Seed: VPQLPHSSSHWLRLPRIFCSCPIGE (PMEL_HUMAN)
  Core: SHWLRLPRI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSXHWXRXPRXFCSCPIGE

SEQ ID NO: 340685 - protein, 25 aa, Artificial Sequence
  Description of Artificial Sequence: Synthetic peptide
  Seed: VPQLPHSSSHWLRLPRIFCSCPIGE (PMEL_HUMAN)
  Core: WLRLPRIFC
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHXLRXPXIFXSCPIGE

SEQ ID NO: 340686 - protein, 25 aa, Artificial Sequence
  Description of Artificial Sequence: Synthetic peptide
  Seed: VPQLPHSSSHWLRLPRIFCSCPIGE (PMEL_HUMAN)
  Core: PRIFCSCPI
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPQLPHSSSHWLRLXRIXCXCPXGE

SEQ ID NO: 340687 - protein, 15 aa, Artificial Sequence
  Description of Artificial Sequence: Synthetic peptide
  Seed: VPRNQDWLGVSRQLR (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLX

SEQ ID NO: 340688 - protein, 16 aa, Artificial Sequence
  Description of Artificial Sequence: Synthetic peptide
  Seed: VPRNQDWLGVSRQLRT (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXT

SEQ ID NO: 340689 - protein, 17 aa, Artificial Sequence
  Description of Artificial Sequence: Synthetic peptide
  Seed: VPRNQDWLGVSRQLRTK (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTK

SEQ ID NO: 340690 - protein, 18 aa, Artificial Sequence
  Description of Artificial Sequence: Synthetic peptide
  Seed: VPRNQDWLGVSRQLRTKA (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKA

SEQ ID NO: 340691 - protein, 19 aa, Artificial Sequence
  Description of Artificial Sequence: Synthetic peptide
  Seed: VPRNQDWLGVSRQLRTKAW (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAW

SEQ ID NO: 340692 - protein, 20 aa, Artificial Sequence
  Description of Artificial Sequence: Synthetic peptide
  Seed: VPRNQDWLGVSRQLRTKAWN (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWN

SEQ ID NO: 340693 - protein, 20 aa, Artificial Sequence
  Description of Artificial Sequence: Synthetic peptide
  Seed: VPRNQDWLGVSRQLRTKAWN (PMEL_HUMAN)
  Core: LGVSRQLRT
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDWXGVXRXLRXKAWN

SEQ ID NO: 340694 - protein, 21 aa, Artificial Sequence
  Description of Artificial Sequence: Synthetic peptide
  Seed: VPRNQDWLGVSRQLRTKAWNR (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWNR

SEQ ID NO: 340695 - protein, 22 aa, Artificial Sequence
  Description of Artificial Sequence: Synthetic peptide
  Seed: VPRNQDWLGVSRQLRTKAWNRQ (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWNRQ

SEQ ID NO: 340696 - protein, 23 aa, Artificial Sequence
  Description of Artificial Sequence: Synthetic peptide
  Seed: VPRNQDWLGVSRQLRTKAWNRQL (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWNRQL

SEQ ID NO: 340697 - protein, 23 aa, Artificial Sequence
  Description of Artificial Sequence: Synthetic peptide
  Seed: VPRNQDWLGVSRQLRTKAWNRQL (PMEL_HUMAN)
  Core: LRTKAWNRQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDWLGVSRQXRTXAXNRXL

SEQ ID NO: 340698 - protein, 24 aa, Artificial Sequence
  Description of Artificial Sequence: Synthetic peptide
  Seed: VPRNQDWLGVSRQLRTKAWNRQLY (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWNRQLY

SEQ ID NO: 340699 - protein, 24 aa, Artificial Sequence
  Description of Artificial Sequence: Synthetic peptide
  Seed: VPRNQDWLGVSRQLRTKAWNRQLY (PMEL_HUMAN)
  Core: LRTKAWNRQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDWLGVSRQXRTXAXNRXLY

SEQ ID NO: 340700 - protein, 25 aa, Artificial Sequence
  Description of Artificial Sequence: Synthetic peptide
  Seed: VPRNQDWLGVSRQLRTKAWNRQLYP (PMEL_HUMAN)
  Core: WLGVSRQLR
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDXLGXSXQLXTKAWNRQLYP

SEQ ID NO: 340701 - protein, 25 aa, Artificial Sequence
  Description of Artificial Sequence: Synthetic peptide
  Seed: VPRNQDWLGVSRQLRTKAWNRQLYP (PMEL_HUMAN)
  Core: LRTKAWNRQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VPRNQDWLGVSRQXRTXAXNRXLYP

SEQ ID NO: 340702 - protein, 20 aa, Artificial Sequence
  Description of Artificial Sequence: Synthetic peptide
  Seed: VPSGEGDAFELTVSCQGGLP (PMEL_HUMAN)
  Core: FELTVSCQG
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPSGEGDAXELXVXCQXGLP

SEQ ID NO: 340703 - protein, 25 aa, Artificial Sequence
  Description of Artificial Sequence: Synthetic peptide
  Seed: VPSGEGDAFELTVSCQGGLPKEACM (PMEL_HUMAN)
  Core: CQGGLPKEA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VPSGEGDAFELTVSXQGXLXKEXCM

SEQ ID NO: 340704 - protein, 14 aa, Artificial Sequence
  Description of Artificial Sequence: Synthetic peptide
  Seed: VPTTEVISTAPVQM (PMEL_HUMAN)
  Core: TEVISTAPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPTXEVXSXAPXQM

SEQ ID NO: 340705 - protein, 14 aa, Artificial Sequence
  Description of Artificial Sequence: Synthetic peptide
  Seed: VPTTEVISTAPVQM (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQX

SEQ ID NO: 340706 - protein, 15 aa, Artificial Sequence
  Description of Artificial Sequence: Synthetic peptide
  Seed: VPTTEVISTAPVQMP (PMEL_HUMAN)
  Core: TEVISTAPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPTXEVXSXAPXQMP

SEQ ID NO: 340707 - protein, 15 aa, Artificial Sequence
  Description of Artificial Sequence: Synthetic peptide
  Seed: VPTTEVISTAPVQMP (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXP

SEQ ID NO: 340708 - protein, 16 aa, Artificial Sequence
  Description of Artificial Sequence: Synthetic peptide
  Seed: VPTTEVISTAPVQMPT (PMEL_HUMAN)
  Core: TEVISTAPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPTXEVXSXAPXQMPT

SEQ ID NO: 340709 - protein, 16 aa, Artificial Sequence
  Description of Artificial Sequence: Synthetic peptide
  Seed: VPTTEVISTAPVQMPT (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPT

SEQ ID NO: 340710 - protein, 16 aa, Artificial Sequence
  Description of Artificial Sequence: Synthetic peptide
  Seed: VPTTEVISTAPVQMPT (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXT

SEQ ID NO: 340711 - protein, 17 aa, Artificial Sequence
  Description of Artificial Sequence: Synthetic peptide
  Seed: VPTTEVISTAPVQMPTA (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTA

SEQ ID NO: 340712 - protein, 17 aa, Artificial Sequence
  Description of Artificial Sequence: Synthetic peptide
  Seed: VPTTEVISTAPVQMPTA (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTA

SEQ ID NO: 340713 - protein, 18 aa, Artificial Sequence
  Description of Artificial Sequence: Synthetic peptide
  Seed: VPTTEVISTAPVQMPTAE (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAE

SEQ ID NO: 340714 - protein, 18 aa, Artificial Sequence
  Description of Artificial Sequence: Synthetic peptide
  Seed: VPTTEVISTAPVQMPTAE (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAE

SEQ ID NO: 340715 - protein, 19 aa, Artificial Sequence
  Description of Artificial Sequence: Synthetic peptide
  Seed: VPTTEVISTAPVQMPTAES (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAES

SEQ ID NO: 340716 - protein, 19 aa, Artificial Sequence
  Description of Artificial Sequence: Synthetic peptide
  Seed: VPTTEVISTAPVQMPTAES (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAES

SEQ ID NO: 340717 - protein, 20 aa, Artificial Sequence
  Description of Artificial Sequence: Synthetic peptide
  Seed: VPTTEVISTAPVQMPTAEST (PMEL_HUMAN)
  Core: EVISTAPVQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPTTXVIXTXPVXMPTAEST

SEQ ID NO: 340718 - protein, 20 aa, Artificial Sequence
  Description of Artificial Sequence: Synthetic peptide
  Seed: VPTTEVISTAPVQMPTAEST (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAEST

SEQ ID NO: 340719 - protein, 20 aa, Artificial Sequence
  Description of Artificial Sequence: Synthetic peptide
  Seed: VPTTEVISTAPVQMPTAEST (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAEST

SEQ ID NO: 340720 - protein, 20 aa, Artificial Sequence
  Description of Artificial Sequence: Synthetic peptide
  Seed: VPTTEVISTAPVQMPTAEST (PMEL_HUMAN)
  Core: TAPVQMPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVISXAPXQXPTXEST

SEQ ID NO: 340721 - protein, 21 aa, Artificial Sequence
  Description of Artificial Sequence: Synthetic peptide
  Seed: VPTTEVISTAPVQMPTAESTG (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAESTG

SEQ ID NO: 340722 - protein, 21 aa, Artificial Sequence
  Description of Artificial Sequence: Synthetic peptide
  Seed: VPTTEVISTAPVQMPTAESTG (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAESTG

SEQ ID NO: 340723 - protein, 22 aa, Artificial Sequence
  Description of Artificial Sequence: Synthetic peptide
  Seed: VPTTEVISTAPVQMPTAESTGM (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAESTGM

SEQ ID NO: 340724 - protein, 22 aa, Artificial Sequence
  Description of Artificial Sequence: Synthetic peptide
  Seed: VPTTEVISTAPVQMPTAESTGM (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAESTGM

SEQ ID NO: 340725 - protein, 23 aa, Artificial Sequence
  Description of Artificial Sequence: Synthetic peptide
  Seed: VPTTEVISTAPVQMPTAESTGMT (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAESTGMT

SEQ ID NO: 340726 - protein, 23 aa, Artificial Sequence
  Description of Artificial Sequence: Synthetic peptide
  Seed: VPTTEVISTAPVQMPTAESTGMT (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAESTGMT

SEQ ID NO: 340727 - protein, 24 aa, Artificial Sequence
  Description of Artificial Sequence: Synthetic peptide
  Seed: VPTTEVISTAPVQMPTAESTGMTP (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAESTGMTP

SEQ ID NO: 340728 - protein, 24 aa, Artificial Sequence
  Description of Artificial Sequence: Synthetic peptide
  Seed: VPTTEVISTAPVQMPTAESTGMTP (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAESTGMTP

SEQ ID NO: 340729 - protein, 25 aa, Artificial Sequence
  Description of Artificial Sequence: Synthetic peptide
  Seed: VPTTEVISTAPVQMPTAESTGMTPE (PMEL_HUMAN)
  Core: VISTAPVQM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXISXAXVQXPTAESTGMTPE

SEQ ID NO: 340730 - protein, 25 aa, Artificial Sequence
  Description of Artificial Sequence: Synthetic peptide
  Seed: VPTTEVISTAPVQMPTAESTGMTPE (PMEL_HUMAN)
  Core: ISTAPVQMP
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVXSTXPXQMXTAESTGMTPE

SEQ ID NO: 340731 - protein, 14 aa, Artificial Sequence
  Description of Artificial Sequence: Synthetic peptide
  Seed: VPTTEVVGTTPGQA (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQX

SEQ ID NO: 340732 - protein, 15 aa, Artificial Sequence
  Description of Artificial Sequence: Synthetic peptide
  Seed: VPTTEVVGTTPGQAP (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXP

SEQ ID NO: 340733 - protein, 16 aa, Artificial Sequence
  Description of Artificial Sequence: Synthetic peptide
  Seed: VPTTEVVGTTPGQAPT (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPT

SEQ ID NO: 340734 - protein, 17 aa, Artificial Sequence
  Description of Artificial Sequence: Synthetic peptide
  Seed: VPTTEVVGTTPGQAPTA (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTA

SEQ ID NO: 340735 - protein, 18 aa, Artificial Sequence
  Description of Artificial Sequence: Synthetic peptide
  Seed: VPTTEVVGTTPGQAPTAE (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAE

SEQ ID NO: 340736 - protein, 19 aa, Artificial Sequence
  Description of Artificial Sequence: Synthetic peptide
  Seed: VPTTEVVGTTPGQAPTAEP (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEP

SEQ ID NO: 340737 - protein, 20 aa, Artificial Sequence
  Description of Artificial Sequence: Synthetic peptide
  Seed: VPTTEVVGTTPGQAPTAEPS (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPS

SEQ ID NO: 340738 - protein, 20 aa, Artificial Sequence
  Description of Artificial Sequence: Synthetic peptide
  Seed: VPTTEVVGTTPGQAPTAEPS (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPS

SEQ ID NO: 340739 - protein, 21 aa, Artificial Sequence
  Description of Artificial Sequence: Synthetic peptide
  Seed: VPTTEVVGTTPGQAPTAEPSG (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPSG

SEQ ID NO: 340740 - protein, 21 aa, Artificial Sequence
  Description of Artificial Sequence: Synthetic peptide
  Seed: VPTTEVVGTTPGQAPTAEPSG (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPSG

SEQ ID NO: 340741 - protein, 22 aa, Artificial Sequence
  Description of Artificial Sequence: Synthetic peptide
  Seed: VPTTEVVGTTPGQAPTAEPSGT (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPSGT

SEQ ID NO: 340742 - protein, 22 aa, Artificial Sequence
  Description of Artificial Sequence: Synthetic peptide
  Seed: VPTTEVVGTTPGQAPTAEPSGT (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPSGT

SEQ ID NO: 340743 - protein, 23 aa, Artificial Sequence
  Description of Artificial Sequence: Synthetic peptide
  Seed: VPTTEVVGTTPGQAPTAEPSGTT (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPSGTT

SEQ ID NO: 340744 - protein, 23 aa, Artificial Sequence
  Description of Artificial Sequence: Synthetic peptide
  Seed: VPTTEVVGTTPGQAPTAEPSGTT (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPSGTT

SEQ ID NO: 340745 - protein, 24 aa, Artificial Sequence
  Description of Artificial Sequence: Synthetic peptide
  Seed: VPTTEVVGTTPGQAPTAEPSGTTS (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPSGTTS

SEQ ID NO: 340746 - protein, 24 aa, Artificial Sequence
  Description of Artificial Sequence: Synthetic peptide
  Seed: VPTTEVVGTTPGQAPTAEPSGTTS (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPSGTTS

SEQ ID NO: 340747 - protein, 25 aa, Artificial Sequence
  Description of Artificial Sequence: Synthetic peptide
  Seed: VPTTEVVGTTPGQAPTAEPSGTTSV (PMEL_HUMAN)
  Core: VVGTTPGQA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEXVGXTXGQXPTAEPSGTTSV

SEQ ID NO: 340748 - protein, 25 aa, Artificial Sequence
  Description of Artificial Sequence: Synthetic peptide
  Seed: VPTTEVVGTTPGQAPTAEPSGTTSV (PMEL_HUMAN)
  Core: TTPGQAPTA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VPTTEVVGXTPXQXPTXEPSGTTSV

SEQ ID NO: 340749 - protein, 14 aa, Artificial Sequence
  Description of Artificial Sequence: Synthetic peptide
  Seed: VPVSEVMGTTLAEM (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEX

SEQ ID NO: 340750 - protein, 15 aa, Artificial Sequence
  Description of Artificial Sequence: Synthetic peptide
  Seed: VPVSEVMGTTLAEMS (PMEL_HUMAN)
  Core: VSEVMGTTL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VPXSEXMXTTXAEMS

SEQ ID NO: 340751 - protein, 15 aa, Artificial Sequence
  Description of Artificial Sequence: Synthetic peptide
  Seed: VPVSEVMGTTLAEMS (PMEL_HUMAN)
  Core: SEVMGTTLA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VPVXEVXGXTLXEMS

SEQ ID NO: 340752 - protein, 15 aa, Artificial Sequence
  Description of Artificial Sequence: Synthetic peptide
  Seed: VPVSEVMGTTLAEMS (PMEL_HUMAN)
  Core: EVMGTTLAE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPVSXVMXTXLAXMS

SEQ ID NO: 340753 - protein, 15 aa, Artificial Sequence
  Description of Artificial Sequence: Synthetic peptide
  Seed: VPVSEVMGTTLAEMS (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXS

SEQ ID NO: 340754 - protein, 16 aa, Artificial Sequence
  Description of Artificial Sequence: Synthetic peptide
  Seed: VPVSEVMGTTLAEMST (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXST

SEQ ID NO: 340755 - protein, 16 aa, Artificial Sequence
  Description of Artificial Sequence: Synthetic peptide
  Seed: VPVSEVMGTTLAEMST (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXT

SEQ ID NO: 340756 - protein, 17 aa, Artificial Sequence
  Description of Artificial Sequence: Synthetic peptide
  Seed: VPVSEVMGTTLAEMSTP (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTP

SEQ ID NO: 340757 - protein, 17 aa, Artificial Sequence
  Description of Artificial Sequence: Synthetic peptide
  Seed: VPVSEVMGTTLAEMSTP (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTP

SEQ ID NO: 340758 - protein, 18 aa, Artificial Sequence
  Description of Artificial Sequence: Synthetic peptide
  Seed: VPVSEVMGTTLAEMSTPE (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPE

SEQ ID NO: 340759 - protein, 18 aa, Artificial Sequence
  Description of Artificial Sequence: Synthetic peptide
  Seed: VPVSEVMGTTLAEMSTPE (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPE

SEQ ID NO: 340760 - protein, 19 aa, Artificial Sequence
  Description of Artificial Sequence: Synthetic peptide
  Seed: VPVSEVMGTTLAEMSTPEA (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEA

SEQ ID NO: 340761 - protein, 19 aa, Artificial Sequence
  Description of Artificial Sequence: Synthetic peptide
  Seed: VPVSEVMGTTLAEMSTPEA (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEA

SEQ ID NO: 340762 - protein, 20 aa, Artificial Sequence
  Description of Artificial Sequence: Synthetic peptide
  Seed: VPVSEVMGTTLAEMSTPEAT (PMEL_HUMAN)
  Core: EVMGTTLAE
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VPVSXVMXTXLAXMSTPEAT

SEQ ID NO: 340763 - protein, 20 aa, Artificial Sequence
  Description of Artificial Sequence: Synthetic peptide
  Seed: VPVSEVMGTTLAEMSTPEAT (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEAT

SEQ ID NO: 340764 - protein, 20 aa, Artificial Sequence
  Description of Artificial Sequence: Synthetic peptide
  Seed: VPVSEVMGTTLAEMSTPEAT (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEAT

SEQ ID NO: 340765 - protein, 20 aa, Artificial Sequence
  Description of Artificial Sequence: Synthetic peptide
  Seed: VPVSEVMGTTLAEMSTPEAT (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXT

SEQ ID NO: 340766 - protein, 21 aa, Artificial Sequence
  Description of Artificial Sequence: Synthetic peptide
  Seed: VPVSEVMGTTLAEMSTPEATG (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEATG

SEQ ID NO: 340767 - protein, 21 aa, Artificial Sequence
  Description of Artificial Sequence: Synthetic peptide
  Seed: VPVSEVMGTTLAEMSTPEATG (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEATG

SEQ ID NO: 340768 - protein, 21 aa, Artificial Sequence
  Description of Artificial Sequence: Synthetic peptide
  Seed: VPVSEVMGTTLAEMSTPEATG (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXTG

SEQ ID NO: 340769 - protein, 22 aa, Artificial Sequence
  Description of Artificial Sequence: Synthetic peptide
  Seed: VPVSEVMGTTLAEMSTPEATGM (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEATGM

SEQ ID NO: 340770 - protein, 22 aa, Artificial Sequence
  Description of Artificial Sequence: Synthetic peptide
  Seed: VPVSEVMGTTLAEMSTPEATGM (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEATGM

SEQ ID NO: 340771 - protein, 22 aa, Artificial Sequence
  Description of Artificial Sequence: Synthetic peptide
  Seed: VPVSEVMGTTLAEMSTPEATGM (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXTGM

SEQ ID NO: 340772 - protein, 23 aa, Artificial Sequence
  Description of Artificial Sequence: Synthetic peptide
  Seed: VPVSEVMGTTLAEMSTPEATGMT (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEATGMT

SEQ ID NO: 340773 - protein, 23 aa, Artificial Sequence
  Description of Artificial Sequence: Synthetic peptide
  Seed: VPVSEVMGTTLAEMSTPEATGMT (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEATGMT

SEQ ID NO: 340774 - protein, 23 aa, Artificial Sequence
  Description of Artificial Sequence: Synthetic peptide
  Seed: VPVSEVMGTTLAEMSTPEATGMT (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXTGMT

SEQ ID NO: 340775 - protein, 23 aa, Artificial Sequence
  Description of Artificial Sequence: Synthetic peptide
  Seed: VPVSEVMGTTLAEMSTPEATGMT (PMEL_HUMAN)
  Core: AEMSTPEAT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTLXEMXTXEAXGMT

SEQ ID NO: 340776 - protein, 24 aa, Artificial Sequence
  Description of Artificial Sequence: Synthetic peptide
  Seed: VPVSEVMGTTLAEMSTPEATGMTP (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEATGMTP

SEQ ID NO: 340777 - protein, 24 aa, Artificial Sequence
  Description of Artificial Sequence: Synthetic peptide
  Seed: VPVSEVMGTTLAEMSTPEATGMTP (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEATGMTP

SEQ ID NO: 340778 - protein, 24 aa, Artificial Sequence
  Description of Artificial Sequence: Synthetic peptide
  Seed: VPVSEVMGTTLAEMSTPEATGMTP (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXTGMTP

SEQ ID NO: 340779 - protein, 24 aa, Artificial Sequence
  Description of Artificial Sequence: Synthetic peptide
  Seed: VPVSEVMGTTLAEMSTPEATGMTP (PMEL_HUMAN)
  Core: AEMSTPEAT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTLXEMXTXEAXGMTP

SEQ ID NO: 340780 - protein, 25 aa, Artificial Sequence
  Description of Artificial Sequence: Synthetic peptide
  Seed: VPVSEVMGTTLAEMSTPEATGMTPA (PMEL_HUMAN)
  Core: VMGTTLAEM
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEXMGXTXAEXSTPEATGMTPA

SEQ ID NO: 340781 - protein, 25 aa, Artificial Sequence
  Description of Artificial Sequence: Synthetic peptide
  Seed: VPVSEVMGTTLAEMSTPEATGMTPA (PMEL_HUMAN)
  Core: MGTTLAEMS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVXGTXLXEMXTPEATGMTPA

SEQ ID NO: 340782 - protein, 25 aa, Artificial Sequence
  Description of Artificial Sequence: Synthetic peptide
  Seed: VPVSEVMGTTLAEMSTPEATGMTPA (PMEL_HUMAN)
  Core: LAEMSTPEA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTXAEXSXPEXTGMTPA

SEQ ID NO: 340783 - protein, 25 aa, Artificial Sequence
  Description of Artificial Sequence: Synthetic peptide
  Seed: VPVSEVMGTTLAEMSTPEATGMTPA (PMEL_HUMAN)
  Core: AEMSTPEAT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VPVSEVMGTTLXEMXTXEAXGMTPA

SEQ ID NO: 340784 - protein, 13 aa, Artificial Sequence
  Description of Artificial Sequence: Synthetic peptide
  Seed: VQGIESAEILQAV (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXV

SEQ ID NO: 340785 - protein, 14 aa, Artificial Sequence
  Description of Artificial Sequence: Synthetic peptide
  Seed: VQGIESAEILQAVP (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVP

SEQ ID NO: 340786 - protein, 15 aa, Artificial Sequence
  Description of Artificial Sequence: Synthetic peptide
  Seed: VQGIESAEILQAVPS (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPS

SEQ ID NO: 340787 - protein, 16 aa, Artificial Sequence
  Description of Artificial Sequence: Synthetic peptide
  Seed: VQGIESAEILQAVPSG (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSG

SEQ ID NO: 340788 - protein, 17 aa, Artificial Sequence
  Description of Artificial Sequence: Synthetic peptide
  Seed: VQGIESAEILQAVPSGE (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGE

SEQ ID NO: 340789 - protein, 17 aa, Artificial Sequence
  Description of Artificial Sequence: Synthetic peptide
  Seed: VQGIESAEILQAVPSGE (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGE

SEQ ID NO: 340790 - protein, 18 aa, Artificial Sequence
  Description of Artificial Sequence: Synthetic peptide
  Seed: VQGIESAEILQAVPSGEG (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEG

SEQ ID NO: 340791 - protein, 19 aa, Artificial Sequence
  Description of Artificial Sequence: Synthetic peptide
  Seed: VQGIESAEILQAVPSGEGD (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGD

SEQ ID NO: 340792 - protein, 19 aa, Artificial Sequence
  Description of Artificial Sequence: Synthetic peptide
  Seed: VQGIESAEILQAVPSGEGD (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGEGD

SEQ ID NO: 340793 - protein, 19 aa, Artificial Sequence
  Description of Artificial Sequence: Synthetic peptide
  Seed: VQGIESAEILQAVPSGEGD (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXD

SEQ ID NO: 340794 - protein, 20 aa, Artificial Sequence
  Description of Artificial Sequence: Synthetic peptide
  Seed: VQGIESAEILQAVPSGEGDA (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDA

SEQ ID NO: 340795 - protein, 20 aa, Artificial Sequence
  Description of Artificial Sequence: Synthetic peptide
  Seed: VQGIESAEILQAVPSGEGDA (PMEL_HUMAN)
  Core: ESAEILQAV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VQGIXSAXIXQAXPSGEGDA

SEQ ID NO: 340796 - protein, 20 aa, Artificial Sequence
  Description of Artificial Sequence: Synthetic peptide
  Seed: VQGIESAEILQAVPSGEGDA (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGEGDA

SEQ ID NO: 340797 - protein, 20 aa, Artificial Sequence
  Description of Artificial Sequence: Synthetic peptide
  Seed: VQGIESAEILQAVPSGEGDA (PMEL_HUMAN)
  Core: ILQAVPSGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEXLQXVXSGXGDA

SEQ ID NO: 340798 - protein, 20 aa, Artificial Sequence
  Description of Artificial Sequence: Synthetic peptide
  Seed: VQGIESAEILQAVPSGEGDA (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDA

SEQ ID NO: 340799 - protein, 21 aa, Artificial Sequence
  Description of Artificial Sequence: Synthetic peptide
  Seed: VQGIESAEILQAVPSGEGDAF (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDAF

SEQ ID NO: 340800 - protein, 21 aa, Artificial Sequence
  Description of Artificial Sequence: Synthetic peptide
  Seed: VQGIESAEILQAVPSGEGDAF (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGEGDAF

SEQ ID NO: 340801 - protein, 21 aa, Artificial Sequence
  Description of Artificial Sequence: Synthetic peptide
  Seed: VQGIESAEILQAVPSGEGDAF (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDAF

SEQ ID NO: 340802 - protein, 22 aa, Artificial Sequence
  Description of Artificial Sequence: Synthetic peptide
  Seed: VQGIESAEILQAVPSGEGDAFE (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDAFE

SEQ ID NO: 340803 - protein, 22 aa, Artificial Sequence
  Description of Artificial Sequence: Synthetic peptide
  Seed: VQGIESAEILQAVPSGEGDAFE (PMEL_HUMAN)
  Core: ILQAVPSGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEXLQXVXSGXGDAFE

SEQ ID NO: 340804 - protein, 22 aa, Artificial Sequence
  Description of Artificial Sequence: Synthetic peptide
  Seed: VQGIESAEILQAVPSGEGDAFE (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDAFE

SEQ ID NO: 340805 - protein, 23 aa, Artificial Sequence
  Description of Artificial Sequence: Synthetic peptide
  Seed: VQGIESAEILQAVPSGEGDAFEL (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDAFEL

SEQ ID NO: 340806 - protein, 23 aa, Artificial Sequence
  Description of Artificial Sequence: Synthetic peptide
  Seed: VQGIESAEILQAVPSGEGDAFEL (PMEL_HUMAN)
  Core: ILQAVPSGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEXLQXVXSGXGDAFEL

SEQ ID NO: 340807 - protein, 23 aa, Artificial Sequence
  Description of Artificial Sequence: Synthetic peptide
  Seed: VQGIESAEILQAVPSGEGDAFEL (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDAFEL

SEQ ID NO: 340808 - protein, 24 aa, Artificial Sequence
  Description of Artificial Sequence: Synthetic peptide
  Seed: VQGIESAEILQAVPSGEGDAFELT (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDAFELT

SEQ ID NO: 340809 - protein, 24 aa, Artificial Sequence
  Description of Artificial Sequence: Synthetic peptide
  Seed: VQGIESAEILQAVPSGEGDAFELT (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGEGDAFELT

SEQ ID NO: 340810 - protein, 24 aa, Artificial Sequence
  Description of Artificial Sequence: Synthetic peptide
  Seed: VQGIESAEILQAVPSGEGDAFELT (PMEL_HUMAN)
  Core: ILQAVPSGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEXLQXVXSGXGDAFELT

SEQ ID NO: 340811 - protein, 24 aa, Artificial Sequence
  Description of Artificial Sequence: Synthetic peptide
  Seed: VQGIESAEILQAVPSGEGDAFELT (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDAFELT

SEQ ID NO: 340812 - protein, 25 aa, Artificial Sequence
  Description of Artificial Sequence: Synthetic peptide
  Seed: VQGIESAEILQAVPSGEGDAFELTV (PMEL_HUMAN)
  Core: IESAEILQA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQGXESXEXLQXVPSGEGDAFELTV

SEQ ID NO: 340813 - protein, 25 aa, Artificial Sequence
  Description of Artificial Sequence: Synthetic peptide
  Seed: VQGIESAEILQAVPSGEGDAFELTV (PMEL_HUMAN)
  Core: AEILQAVPS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESXEIXQXVPXGEGDAFELTV

SEQ ID NO: 340814 - protein, 25 aa, Artificial Sequence
  Description of Artificial Sequence: Synthetic peptide
  Seed: VQGIESAEILQAVPSGEGDAFELTV (PMEL_HUMAN)
  Core: ILQAVPSGE
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEXLQXVXSGXGDAFELTV

SEQ ID NO: 340815 - protein, 25 aa, Artificial Sequence
  Description of Artificial Sequence: Synthetic peptide
  Seed: VQGIESAEILQAVPSGEGDAFELTV (PMEL_HUMAN)
  Core: LQAVPSGEG
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VQGIESAEIXQAXPXGEXDAFELTV

SEQ ID NO: 340816 - protein, 16 aa, Artificial Sequence
  Description of Artificial Sequence: Synthetic peptide
  Seed: VQMPTAESTGMTPEKV (PMEL_HUMAN)
  Core: PTAESTGMT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQMXTAXSXGMXPEKV

SEQ ID NO: 340817 - protein, 20 aa, Artificial Sequence
  Description of Artificial Sequence: Synthetic peptide
  Seed: VQMPTAESTGMTPEKVPVSE (PMEL_HUMAN)
  Core: STGMTPEKV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQMPTAEXTGXTXEKXPVSE

SEQ ID NO: 340818 - protein, 15 aa, Artificial Sequence
  Description of Artificial Sequence: Synthetic peptide
  Seed: VQVPTTEVISTAPVQ (PMEL_HUMAN)
  Core: PTTEVISTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQVXTTXVXSTXPVQ

SEQ ID NO: 340819 - protein, 16 aa, Artificial Sequence
  Description of Artificial Sequence: Synthetic peptide
  Seed: VQVPTTEVISTAPVQM (PMEL_HUMAN)
  Core: PTTEVISTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQVXTTXVXSTXPVQM

SEQ ID NO: 340820 - protein, 16 aa, Artificial Sequence
  Description of Artificial Sequence: Synthetic peptide
  Seed: VQVPTTEVISTAPVQM (PMEL_HUMAN)
  Core: TEVISTAPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTXEVXSXAPXQM

SEQ ID NO: 340821 - protein, 16 aa, Artificial Sequence
  Description of Artificial Sequence: Synthetic peptide
  Seed: VQVPTTEVISTAPVQM (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQX

SEQ ID NO: 340822 - protein, 17 aa, Artificial Sequence
  Description of Artificial Sequence: Synthetic peptide
  Seed: VQVPTTEVISTAPVQMP (PMEL_HUMAN)
  Core: PTTEVISTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VQVXTTXVXSTXPVQMP

SEQ ID NO: 340823 - protein, 17 aa, Artificial Sequence
  Description of Artificial Sequence: Synthetic peptide
  Seed: VQVPTTEVISTAPVQMP (PMEL_HUMAN)
  Core: TEVISTAPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTXEVXSXAPXQMP

SEQ ID NO: 340824 - protein, 17 aa, Artificial Sequence
  Description of Artificial Sequence: Synthetic peptide
  Seed: VQVPTTEVISTAPVQMP (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXP

SEQ ID NO: 340825 - protein, 18 aa, Artificial Sequence
  Description of Artificial Sequence: Synthetic peptide
  Seed: VQVPTTEVISTAPVQMPT (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPT

SEQ ID NO: 340826 - protein, 19 aa, Artificial Sequence
  Description of Artificial Sequence: Synthetic peptide
  Seed: VQVPTTEVISTAPVQMPTA (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTA

SEQ ID NO: 340827 - protein, 19 aa, Artificial Sequence
  Description of Artificial Sequence: Synthetic peptide
  Seed: VQVPTTEVISTAPVQMPTA (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTA

SEQ ID NO: 340828 - protein, 20 aa, Artificial Sequence
  Description of Artificial Sequence: Synthetic peptide
  Seed: VQVPTTEVISTAPVQMPTAE (PMEL_HUMAN)
  Core: TEVISTAPV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTXEVXSXAPXQMPTAE

SEQ ID NO: 340829 - protein, 20 aa, Artificial Sequence
  Description of Artificial Sequence: Synthetic peptide
  Seed: VQVPTTEVISTAPVQMPTAE (PMEL_HUMAN)
  Core: EVISTAPVQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTXVIXTXPVXMPTAE

SEQ ID NO: 340830 - protein, 20 aa, Artificial Sequence
  Description of Artificial Sequence: Synthetic peptide
  Seed: VQVPTTEVISTAPVQMPTAE (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAE

SEQ ID NO: 340831 - protein, 20 aa, Artificial Sequence
  Description of Artificial Sequence: Synthetic peptide
  Seed: VQVPTTEVISTAPVQMPTAE (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAE

SEQ ID NO: 340832 - protein, 21 aa, Artificial Sequence
  Description of Artificial Sequence: Synthetic peptide
  Seed: VQVPTTEVISTAPVQMPTAES (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAES

SEQ ID NO: 340833 - protein, 21 aa, Artificial Sequence
  Description of Artificial Sequence: Synthetic peptide
  Seed: VQVPTTEVISTAPVQMPTAES (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAES

SEQ ID NO: 340834 - protein, 22 aa, Artificial Sequence
  Description of Artificial Sequence: Synthetic peptide
  Seed: VQVPTTEVISTAPVQMPTAEST (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAEST

SEQ ID NO: 340835 - protein, 22 aa, Artificial Sequence
  Description of Artificial Sequence: Synthetic peptide
  Seed: VQVPTTEVISTAPVQMPTAEST (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAEST

SEQ ID NO: 340836 - protein, 23 aa, Artificial Sequence
  Description of Artificial Sequence: Synthetic peptide
  Seed: VQVPTTEVISTAPVQMPTAESTG (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAESTG

SEQ ID NO: 340837 - protein, 23 aa, Artificial Sequence
  Description of Artificial Sequence: Synthetic peptide
  Seed: VQVPTTEVISTAPVQMPTAESTG (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAESTG

SEQ ID NO: 340838 - protein, 24 aa, Artificial Sequence
  Description of Artificial Sequence: Synthetic peptide
  Seed: VQVPTTEVISTAPVQMPTAESTGM (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAESTGM

SEQ ID NO: 340839 - protein, 24 aa, Artificial Sequence
  Description of Artificial Sequence: Synthetic peptide
  Seed: VQVPTTEVISTAPVQMPTAESTGM (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAESTGM

SEQ ID NO: 340840 - protein, 25 aa, Artificial Sequence
  Description of Artificial Sequence: Synthetic peptide
  Seed: VQVPTTEVISTAPVQMPTAESTGMT (PMEL_HUMAN)
  Core: VISTAPVQM
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEXISXAXVQXPTAESTGMT

SEQ ID NO: 340841 - protein, 25 aa, Artificial Sequence
  Description of Artificial Sequence: Synthetic peptide
  Seed: VQVPTTEVISTAPVQMPTAESTGMT (PMEL_HUMAN)
  Core: ISTAPVQMP
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VQVPTTEVXSTXPXQMXTAESTGMT

SEQ ID NO: 340842 - protein, 13 aa, Artificial Sequence
  Description of Artificial Sequence: Synthetic peptide
  Seed: VSCQGGLPKEACM (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCM

SEQ ID NO: 340843 - protein, 14 aa, Artificial Sequence
  Description of Artificial Sequence: Synthetic peptide
  Seed: VSCQGGLPKEACME (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCME

SEQ ID NO: 340844 - protein, 15 aa, Artificial Sequence
  Description of Artificial Sequence: Synthetic peptide
  Seed: VSCQGGLPKEACMEI (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEI

SEQ ID NO: 340845 - protein, 16 aa, Artificial Sequence
  Description of Artificial Sequence: Synthetic peptide
  Seed: VSCQGGLPKEACMEIS (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEIS

SEQ ID NO: 340846 - protein, 17 aa, Artificial Sequence
  Description of Artificial Sequence: Synthetic peptide
  Seed: VSCQGGLPKEACMEISS (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEISS

SEQ ID NO: 340847 - protein, 19 aa, Artificial Sequence
  Description of Artificial Sequence: Synthetic peptide
  Seed: VSCQGGLPKEACMEISSPG (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEISSPG

SEQ ID NO: 340848 - protein, 20 aa, Artificial Sequence
  Description of Artificial Sequence: Synthetic peptide
  Seed: VSCQGGLPKEACMEISSPGC (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEISSPGC

SEQ ID NO: 340849 - protein, 24 aa, Artificial Sequence
  Description of Artificial Sequence: Synthetic peptide
  Seed: VSCQGGLPKEACMEISSPGCQPPA (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEISSPGCQPPA

SEQ ID NO: 340850 - protein, 25 aa, Artificial Sequence
  Description of Artificial Sequence: Synthetic peptide
  Seed: VSCQGGLPKEACMEISSPGCQPPAQ (PMEL_HUMAN)
  Core: CQGGLPKEA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXQGXLXKEXCMEISSPGCQPPAQ

SEQ ID NO: 340851 - protein, 13 aa, Artificial Sequence
  Description of Artificial Sequence: Synthetic peptide
  Seed: VSEVMGTTLAEMS (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXS

SEQ ID NO: 340852 - protein, 14 aa, Artificial Sequence
  Description of Artificial Sequence: Synthetic peptide
  Seed: VSEVMGTTLAEMST (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXST

SEQ ID NO: 340853 - protein, 15 aa, Artificial Sequence
  Description of Artificial Sequence: Synthetic peptide
  Seed: VSEVMGTTLAEMSTP (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTP

SEQ ID NO: 340854 - protein, 15 aa, Artificial Sequence
  Description of Artificial Sequence: Synthetic peptide
  Seed: VSEVMGTTLAEMSTP (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTP

SEQ ID NO: 340855 - protein, 16 aa, Artificial Sequence
  Description of Artificial Sequence: Synthetic peptide
  Seed: VSEVMGTTLAEMSTPE (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPE

SEQ ID NO: 340856 - protein, 16 aa, Artificial Sequence
  Description of Artificial Sequence: Synthetic peptide
  Seed: VSEVMGTTLAEMSTPE (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPE

SEQ ID NO: 340857 - protein, 17 aa, Artificial Sequence
  Description of Artificial Sequence: Synthetic peptide
  Seed: VSEVMGTTLAEMSTPEA (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEA

SEQ ID NO: 340858 - protein, 17 aa, Artificial Sequence
  Description of Artificial Sequence: Synthetic peptide
  Seed: VSEVMGTTLAEMSTPEA (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEA

SEQ ID NO: 340859 - protein, 18 aa, Artificial Sequence
  Description of Artificial Sequence: Synthetic peptide
  Seed: VSEVMGTTLAEMSTPEAT (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEAT

SEQ ID NO: 340860 - protein, 18 aa, Artificial Sequence
  Description of Artificial Sequence: Synthetic peptide
  Seed: VSEVMGTTLAEMSTPEAT (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEAT

SEQ ID NO: 340861 - protein, 19 aa, Artificial Sequence
  Description of Artificial Sequence: Synthetic peptide
  Seed: VSEVMGTTLAEMSTPEATG (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATG

SEQ ID NO: 340862 - protein, 19 aa, Artificial Sequence
  Description of Artificial Sequence: Synthetic peptide
  Seed: VSEVMGTTLAEMSTPEATG (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATG

SEQ ID NO: 340863 - protein, 19 aa, Artificial Sequence
  Description of Artificial Sequence: Synthetic peptide
  Seed: VSEVMGTTLAEMSTPEATG (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTG

SEQ ID NO: 340864 - protein, 20 aa, Artificial Sequence
  Description of Artificial Sequence: Synthetic peptide
  Seed: VSEVMGTTLAEMSTPEATGM (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGM

SEQ ID NO: 340865 - protein, 20 aa, Artificial Sequence
  Description of Artificial Sequence: Synthetic peptide
  Seed: VSEVMGTTLAEMSTPEATGM (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGM

SEQ ID NO: 340866 - protein, 20 aa, Artificial Sequence
  Description of Artificial Sequence: Synthetic peptide
  Seed: VSEVMGTTLAEMSTPEATGM (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGM

SEQ ID NO: 340867 - protein, 20 aa, Artificial Sequence
  Description of Artificial Sequence: Synthetic peptide
  Seed: VSEVMGTTLAEMSTPEATGM (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGM

SEQ ID NO: 340868 - protein, 21 aa, Artificial Sequence
  Description of Artificial Sequence: Synthetic peptide
  Seed: VSEVMGTTLAEMSTPEATGMT (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGMT

SEQ ID NO: 340869 - protein, 21 aa, Artificial Sequence
  Description of Artificial Sequence: Synthetic peptide
  Seed: VSEVMGTTLAEMSTPEATGMT (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGMT

SEQ ID NO: 340870 - protein, 21 aa, Artificial Sequence
  Description of Artificial Sequence: Synthetic peptide
  Seed: VSEVMGTTLAEMSTPEATGMT (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGMT

SEQ ID NO: 340871 - protein, 21 aa, Artificial Sequence
  Description of Artificial Sequence: Synthetic peptide
  Seed: VSEVMGTTLAEMSTPEATGMT (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGMT

SEQ ID NO: 340872 - protein, 22 aa, Artificial Sequence
  Description of Artificial Sequence: Synthetic peptide
  Seed: VSEVMGTTLAEMSTPEATGMTP (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGMTP

SEQ ID NO: 340873 - protein, 22 aa, Artificial Sequence
  Description of Artificial Sequence: Synthetic peptide
  Seed: VSEVMGTTLAEMSTPEATGMTP (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGMTP

SEQ ID NO: 340874 - protein, 22 aa, Artificial Sequence
  Description of Artificial Sequence: Synthetic peptide
  Seed: VSEVMGTTLAEMSTPEATGMTP (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGMTP

SEQ ID NO: 340875 - protein, 22 aa, Artificial Sequence
  Description of Artificial Sequence: Synthetic peptide
  Seed: VSEVMGTTLAEMSTPEATGMTP (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGMTP

SEQ ID NO: 340876 - protein, 23 aa, Artificial Sequence
  Description of Artificial Sequence: Synthetic peptide
  Seed: VSEVMGTTLAEMSTPEATGMTPA (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGMTPA

SEQ ID NO: 340877 - protein, 23 aa, Artificial Sequence
  Description of Artificial Sequence: Synthetic peptide
  Seed: VSEVMGTTLAEMSTPEATGMTPA (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGMTPA

SEQ ID NO: 340878 - protein, 23 aa, Artificial Sequence
  Description of Artificial Sequence: Synthetic peptide
  Seed: VSEVMGTTLAEMSTPEATGMTPA (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGMTPA

SEQ ID NO: 340879 - protein, 23 aa, Artificial Sequence
  Description of Artificial Sequence: Synthetic peptide
  Seed: VSEVMGTTLAEMSTPEATGMTPA (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGMTPA

SEQ ID NO: 340880 - protein, 24 aa, Artificial Sequence
  Description of Artificial Sequence: Synthetic peptide
  Seed: VSEVMGTTLAEMSTPEATGMTPAE (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGMTPAE

SEQ ID NO: 340881 - protein, 24 aa, Artificial Sequence
  Description of Artificial Sequence: Synthetic peptide
  Seed: VSEVMGTTLAEMSTPEATGMTPAE (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGMTPAE

SEQ ID NO: 340882 - protein, 24 aa, Artificial Sequence
  Description of Artificial Sequence: Synthetic peptide
  Seed: VSEVMGTTLAEMSTPEATGMTPAE (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGMTPAE

SEQ ID NO: 340883 - protein, 24 aa, Artificial Sequence
  Description of Artificial Sequence: Synthetic peptide
  Seed: VSEVMGTTLAEMSTPEATGMTPAE (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGMTPAE

SEQ ID NO: 340884 - protein, 25 aa, Artificial Sequence
  Description of Artificial Sequence: Synthetic peptide
  Seed: VSEVMGTTLAEMSTPEATGMTPAEV (PMEL_HUMAN)
  Core: VMGTTLAEM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSEXMGXTXAEXSTPEATGMTPAEV

SEQ ID NO: 340885 - protein, 25 aa, Artificial Sequence
  Description of Artificial Sequence: Synthetic peptide
  Seed: VSEVMGTTLAEMSTPEATGMTPAEV (PMEL_HUMAN)
  Core: MGTTLAEMS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSEVXGTXLXEMXTPEATGMTPAEV

SEQ ID NO: 340886 - protein, 25 aa, Artificial Sequence
  Description of Artificial Sequence: Synthetic peptide
  Seed: VSEVMGTTLAEMSTPEATGMTPAEV (PMEL_HUMAN)
  Core: LAEMSTPEA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTXAEXSXPEXTGMTPAEV

SEQ ID NO: 340887 - protein, 25 aa, Artificial Sequence
  Description of Artificial Sequence: Synthetic peptide
  Seed: VSEVMGTTLAEMSTPEATGMTPAEV (PMEL_HUMAN)
  Core: AEMSTPEAT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSEVMGTTLXEMXTXEAXGMTPAEV

SEQ ID NO: 340888 - protein, 13 aa, Artificial Sequence
  Description of Artificial Sequence: Synthetic peptide
  Seed: VSGLSIGTGRAML (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXL

SEQ ID NO: 340889 - protein, 14 aa, Artificial Sequence
  Description of Artificial Sequence: Synthetic peptide
  Seed: VSGLSIGTGRAMLG (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLG

SEQ ID NO: 340890 - protein, 14 aa, Artificial Sequence
  Description of Artificial Sequence: Synthetic peptide
  Seed: VSGLSIGTGRAMLG (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLX

SEQ ID NO: 340891 - protein, 15 aa, Artificial Sequence
  Description of Artificial Sequence: Synthetic peptide
  Seed: VSGLSIGTGRAMLGT (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLGT

SEQ ID NO: 340892 - protein, 15 aa, Artificial Sequence
  Description of Artificial Sequence: Synthetic peptide
  Seed: VSGLSIGTGRAMLGT (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXT

SEQ ID NO: 340893 - protein, 16 aa, Artificial Sequence
  Description of Artificial Sequence: Synthetic peptide
  Seed: VSGLSIGTGRAMLGTH (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLGTH

SEQ ID NO: 340894 - protein, 16 aa, Artificial Sequence
  Description of Artificial Sequence: Synthetic peptide
  Seed: VSGLSIGTGRAMLGTH (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTH

SEQ ID NO: 340895 - protein, 17 aa, Artificial Sequence
  Description of Artificial Sequence: Synthetic peptide
  Seed: VSGLSIGTGRAMLGTHT (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLGTHT

SEQ ID NO: 340896 - protein, 17 aa, Artificial Sequence
  Description of Artificial Sequence: Synthetic peptide
  Seed: VSGLSIGTGRAMLGTHT (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHT

SEQ ID NO: 340897 - protein, 18 aa, Artificial Sequence
  Description of Artificial Sequence: Synthetic peptide
  Seed: VSGLSIGTGRAMLGTHTM (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTM

SEQ ID NO: 340898 - protein, 19 aa, Artificial Sequence
  Description of Artificial Sequence: Synthetic peptide
  Seed: VSGLSIGTGRAMLGTHTME (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLGTHTME

SEQ ID NO: 340899 - protein, 19 aa, Artificial Sequence
  Description of Artificial Sequence: Synthetic peptide
  Seed: VSGLSIGTGRAMLGTHTME (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTME

SEQ ID NO: 340900 - protein, 20 aa, Artificial Sequence
  Description of Artificial Sequence: Synthetic peptide
  Seed: VSGLSIGTGRAMLGTHTMEV (PMEL_HUMAN)
  Core: LSIGTGRAM
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSGXSIXTXRAXLGTHTMEV

SEQ ID NO: 340901 - protein, 20 aa, Artificial Sequence
  Description of Artificial Sequence: Synthetic peptide
  Seed: VSGLSIGTGRAMLGTHTMEV (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEV

SEQ ID NO: 340902 - protein, 20 aa, Artificial Sequence
  Description of Artificial Sequence: Synthetic peptide
  Seed: VSGLSIGTGRAMLGTHTMEV (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEV

SEQ ID NO: 340903 - protein, 20 aa, Artificial Sequence
  Description of Artificial Sequence: Synthetic peptide
  Seed: VSGLSIGTGRAMLGTHTMEV (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEX

SEQ ID NO: 340904 - protein, 21 aa, Artificial Sequence
  Description of Artificial Sequence: Synthetic peptide
  Seed: VSGLSIGTGRAMLGTHTMEVT (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEVT

SEQ ID NO: 340905 - protein, 21 aa, Artificial Sequence
  Description of Artificial Sequence: Synthetic peptide
  Seed: VSGLSIGTGRAMLGTHTMEVT (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEVT

SEQ ID NO: 340906 - protein, 21 aa, Artificial Sequence
  Description of Artificial Sequence: Synthetic peptide
  Seed: VSGLSIGTGRAMLGTHTMEVT (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEXT

SEQ ID NO: 340907 - protein, 22 aa, Artificial Sequence
  Description of Artificial Sequence: Synthetic peptide
  Seed: VSGLSIGTGRAMLGTHTMEVTV (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEVTV

SEQ ID NO: 340908 - protein, 22 aa, Artificial Sequence
  Description of Artificial Sequence: Synthetic peptide
  Seed: VSGLSIGTGRAMLGTHTMEVTV (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEVTV

SEQ ID NO: 340909 - protein, 22 aa, Artificial Sequence
  Description of Artificial Sequence: Synthetic peptide
  Seed: VSGLSIGTGRAMLGTHTMEVTV (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEXTV

SEQ ID NO: 340910 - protein, 23 aa, Artificial Sequence
  Description of Artificial Sequence: Synthetic peptide
  Seed: VSGLSIGTGRAMLGTHTMEVTVY (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEVTVY

SEQ ID NO: 340911 - protein, 23 aa, Artificial Sequence
  Description of Artificial Sequence: Synthetic peptide
  Seed: VSGLSIGTGRAMLGTHTMEVTVY (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEVTVY

SEQ ID NO: 340912 - protein, 23 aa, Artificial Sequence
  Description of Artificial Sequence: Synthetic peptide
  Seed: VSGLSIGTGRAMLGTHTMEVTVY (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEXTVY

SEQ ID NO: 340913 - protein, 24 aa, Artificial Sequence
  Description of Artificial Sequence: Synthetic peptide
  Seed: VSGLSIGTGRAMLGTHTMEVTVYH (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEVTVYH

SEQ ID NO: 340914 - protein, 24 aa, Artificial Sequence
  Description of Artificial Sequence: Synthetic peptide
  Seed: VSGLSIGTGRAMLGTHTMEVTVYH (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEVTVYH

SEQ ID NO: 340915 - protein, 24 aa, Artificial Sequence
  Description of Artificial Sequence: Synthetic peptide
  Seed: VSGLSIGTGRAMLGTHTMEVTVYH (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEXTVYH

SEQ ID NO: 340916 - protein, 24 aa, Artificial Sequence
  Description of Artificial Sequence: Synthetic peptide
  Seed: VSGLSIGTGRAMLGTHTMEVTVYH (PMEL_HUMAN)
  Core: LGTHTMEVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAMXGTXTXEVXVYH

SEQ ID NO: 340917 - protein, 25 aa, Artificial Sequence
  Description of Artificial Sequence: Synthetic peptide
  Seed: VSGLSIGTGRAMLGTHTMEVTVYHR (PMEL_HUMAN)
  Core: IGTGRAMLG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSXGTXRXMLXTHTMEVTVYHR

SEQ ID NO: 340918 - protein, 25 aa, Artificial Sequence
  Description of Artificial Sequence: Synthetic peptide
  Seed: VSGLSIGTGRAMLGTHTMEVTVYHR (PMEL_HUMAN)
  Core: RAMLGTHTM
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGXAMXGXHTXEVTVYHR

SEQ ID NO: 340919 - protein, 25 aa, Artificial Sequence
  Description of Artificial Sequence: Synthetic peptide
  Seed: VSGLSIGTGRAMLGTHTMEVTVYHR (PMEL_HUMAN)
  Core: MLGTHTMEV
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAXLGXHXMEXTVYHR

SEQ ID NO: 340920 - protein, 25 aa, Artificial Sequence
  Description of Artificial Sequence: Synthetic peptide
  Seed: VSGLSIGTGRAMLGTHTMEVTVYHR (PMEL_HUMAN)
  Core: LGTHTMEVT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSGLSIGTGRAMXGTXTXEVXVYHR

SEQ ID NO: 340921 - protein, 13 aa, Artificial Sequence
  Description of Artificial Sequence: Synthetic peptide
  Seed: VSIVVLSGTTAAQ (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQ

SEQ ID NO: 340922 - protein, 13 aa, Artificial Sequence
  Description of Artificial Sequence: Synthetic peptide
  Seed: VSIVVLSGTTAAQ (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQ

SEQ ID NO: 340923 - protein, 13 aa, Artificial Sequence
  Description of Artificial Sequence: Synthetic peptide
  Seed: VSIVVLSGTTAAQ (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAX

SEQ ID NO: 340924 - protein, 14 aa, Artificial Sequence
  Description of Artificial Sequence: Synthetic peptide
  Seed: VSIVVLSGTTAAQV (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQV

SEQ ID NO: 340925 - protein, 14 aa, Artificial Sequence
  Description of Artificial Sequence: Synthetic peptide
  Seed: VSIVVLSGTTAAQV (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQV

SEQ ID NO: 340926 - protein, 14 aa, Artificial Sequence
  Description of Artificial Sequence: Synthetic peptide
  Seed: VSIVVLSGTTAAQV (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXV

SEQ ID NO: 340927 - protein, 14 aa, Artificial Sequence
  Description of Artificial Sequence: Synthetic peptide
  Seed: VSIVVLSGTTAAQV (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQX

SEQ ID NO: 340928 - protein, 15 aa, Artificial Sequence
  Description of Artificial Sequence: Synthetic peptide
  Seed: VSIVVLSGTTAAQVT (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVT

SEQ ID NO: 340929 - protein, 15 aa, Artificial Sequence
  Description of Artificial Sequence: Synthetic peptide
  Seed: VSIVVLSGTTAAQVT (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVT

SEQ ID NO: 340930 - protein, 15 aa, Artificial Sequence
  Description of Artificial Sequence: Synthetic peptide
  Seed: VSIVVLSGTTAAQVT (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVT

SEQ ID NO: 340931 - protein, 15 aa, Artificial Sequence
  Description of Artificial Sequence: Synthetic peptide
  Seed: VSIVVLSGTTAAQVT (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXT

SEQ ID NO: 340932 - protein, 16 aa, Artificial Sequence
  Description of Artificial Sequence: Synthetic peptide
  Seed: VSIVVLSGTTAAQVTT (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTT

SEQ ID NO: 340933 - protein, 16 aa, Artificial Sequence
  Description of Artificial Sequence: Synthetic peptide
  Seed: VSIVVLSGTTAAQVTT (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTT

SEQ ID NO: 340934 - protein, 16 aa, Artificial Sequence
  Description of Artificial Sequence: Synthetic peptide
  Seed: VSIVVLSGTTAAQVTT (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTT

SEQ ID NO: 340935 - protein, 16 aa, Artificial Sequence
  Description of Artificial Sequence: Synthetic peptide
  Seed: VSIVVLSGTTAAQVTT (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTT

SEQ ID NO: 340936 - protein, 17 aa, Artificial Sequence
  Description of Artificial Sequence: Synthetic peptide
  Seed: VSIVVLSGTTAAQVTTT (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTT

SEQ ID NO: 340937 - protein, 17 aa, Artificial Sequence
  Description of Artificial Sequence: Synthetic peptide
  Seed: VSIVVLSGTTAAQVTTT (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTT

SEQ ID NO: 340938 - protein, 17 aa, Artificial Sequence
  Description of Artificial Sequence: Synthetic peptide
  Seed: VSIVVLSGTTAAQVTTT (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTT

SEQ ID NO: 340939 - protein, 17 aa, Artificial Sequence
  Description of Artificial Sequence: Synthetic peptide
  Seed: VSIVVLSGTTAAQVTTT (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTT

SEQ ID NO: 340940 - protein, 18 aa, Artificial Sequence
  Description of Artificial Sequence: Synthetic peptide
  Seed: VSIVVLSGTTAAQVTTTE (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTE

SEQ ID NO: 340941 - protein, 18 aa, Artificial Sequence
  Description of Artificial Sequence: Synthetic peptide
  Seed: VSIVVLSGTTAAQVTTTE (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTE

SEQ ID NO: 340942 - protein, 18 aa, Artificial Sequence
  Description of Artificial Sequence: Synthetic peptide
  Seed: VSIVVLSGTTAAQVTTTE (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTE

SEQ ID NO: 340943 - protein, 18 aa, Artificial Sequence
  Description of Artificial Sequence: Synthetic peptide
  Seed: VSIVVLSGTTAAQVTTTE (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTE

SEQ ID NO: 340944 - protein, 19 aa, Artificial Sequence
  Description of Artificial Sequence: Synthetic peptide
  Seed: VSIVVLSGTTAAQVTTTEW (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEW

SEQ ID NO: 340945 - protein, 19 aa, Artificial Sequence
  Description of Artificial Sequence: Synthetic peptide
  Seed: VSIVVLSGTTAAQVTTTEW (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEW

SEQ ID NO: 340946 - protein, 19 aa, Artificial Sequence
  Description of Artificial Sequence: Synthetic peptide
  Seed: VSIVVLSGTTAAQVTTTEW (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEW

SEQ ID NO: 340947 - protein, 19 aa, Artificial Sequence
  Description of Artificial Sequence: Synthetic peptide
  Seed: VSIVVLSGTTAAQVTTTEW (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEW

SEQ ID NO: 340948 - protein, 19 aa, Artificial Sequence
  Description of Artificial Sequence: Synthetic peptide
  Seed: VSIVVLSGTTAAQVTTTEW (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEW

SEQ ID NO: 340949 - protein, 20 aa, Artificial Sequence
  Description of Artificial Sequence: Synthetic peptide
  Seed: VSIVVLSGTTAAQVTTTEWV (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWV

SEQ ID NO: 340950 - protein, 20 aa, Artificial Sequence
  Description of Artificial Sequence: Synthetic peptide
  Seed: VSIVVLSGTTAAQVTTTEWV (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWV

SEQ ID NO: 340951 - protein, 20 aa, Artificial Sequence
  Description of Artificial Sequence: Synthetic peptide
  Seed: VSIVVLSGTTAAQVTTTEWV (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWV

SEQ ID NO: 340952 - protein, 20 aa, Artificial Sequence
  Description of Artificial Sequence: Synthetic peptide
  Seed: VSIVVLSGTTAAQVTTTEWV (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWV

SEQ ID NO: 340953 - protein, 20 aa, Artificial Sequence
  Description of Artificial Sequence: Synthetic peptide
  Seed: VSIVVLSGTTAAQVTTTEWV (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWV

SEQ ID NO: 340954 - protein, 21 aa, Artificial Sequence
  Description of Artificial Sequence: Synthetic peptide
  Seed: VSIVVLSGTTAAQVTTTEWVE (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWVE

SEQ ID NO: 340955 - protein, 21 aa, Artificial Sequence
  Description of Artificial Sequence: Synthetic peptide
  Seed: VSIVVLSGTTAAQVTTTEWVE (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWVE

SEQ ID NO: 340956 - protein, 21 aa, Artificial Sequence
  Description of Artificial Sequence: Synthetic peptide
  Seed: VSIVVLSGTTAAQVTTTEWVE (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWVE

SEQ ID NO: 340957 - protein, 21 aa, Artificial Sequence
  Description of Artificial Sequence: Synthetic peptide
  Seed: VSIVVLSGTTAAQVTTTEWVE (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWVE

SEQ ID NO: 340958 - protein, 21 aa, Artificial Sequence
  Description of Artificial Sequence: Synthetic peptide
  Seed: VSIVVLSGTTAAQVTTTEWVE (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWVE

SEQ ID NO: 340959 - protein, 22 aa, Artificial Sequence
  Description of Artificial Sequence: Synthetic peptide
  Seed: VSIVVLSGTTAAQVTTTEWVET (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWVET

SEQ ID NO: 340960 - protein, 22 aa, Artificial Sequence
  Description of Artificial Sequence: Synthetic peptide
  Seed: VSIVVLSGTTAAQVTTTEWVET (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWVET

SEQ ID NO: 340961 - protein, 22 aa, Artificial Sequence
  Description of Artificial Sequence: Synthetic peptide
  Seed: VSIVVLSGTTAAQVTTTEWVET (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWVET

SEQ ID NO: 340962 - protein, 22 aa, Artificial Sequence
  Description of Artificial Sequence: Synthetic peptide
  Seed: VSIVVLSGTTAAQVTTTEWVET (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWVET

SEQ ID NO: 340963 - protein, 22 aa, Artificial Sequence
  Description of Artificial Sequence: Synthetic peptide
  Seed: VSIVVLSGTTAAQVTTTEWVET (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWVET

SEQ ID NO: 340964 - protein, 23 aa, Artificial Sequence
  Description of Artificial Sequence: Synthetic peptide
  Seed: VSIVVLSGTTAAQVTTTEWVETT (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWVETT

SEQ ID NO: 340965 - protein, 23 aa, Artificial Sequence
  Description of Artificial Sequence: Synthetic peptide
  Seed: VSIVVLSGTTAAQVTTTEWVETT (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWVETT

SEQ ID NO: 340966 - protein, 23 aa, Artificial Sequence
  Description of Artificial Sequence: Synthetic peptide
  Seed: VSIVVLSGTTAAQVTTTEWVETT (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWVETT

SEQ ID NO: 340967 - protein, 23 aa, Artificial Sequence
  Description of Artificial Sequence: Synthetic peptide
  Seed: VSIVVLSGTTAAQVTTTEWVETT (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWVETT

SEQ ID NO: 340968 - protein, 23 aa, Artificial Sequence
  Description of Artificial Sequence: Synthetic peptide
  Seed: VSIVVLSGTTAAQVTTTEWVETT (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWVETT

SEQ ID NO: 340969 - protein, 23 aa, Artificial Sequence
  Description of Artificial Sequence: Synthetic peptide
  Seed: VSIVVLSGTTAAQVTTTEWVETT (PMEL_HUMAN)
  Core: VTTTEWVET
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGTTAAQXTTXEXVEXT

SEQ ID NO: 340970 - protein, 24 aa, Artificial Sequence
  Description of Artificial Sequence: Synthetic peptide
  Seed: VSIVVLSGTTAAQVTTTEWVETTA (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWVETTA

SEQ ID NO: 340971 - protein, 24 aa, Artificial Sequence
  Description of Artificial Sequence: Synthetic peptide
  Seed: VSIVVLSGTTAAQVTTTEWVETTA (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWVETTA

SEQ ID NO: 340972 - protein, 24 aa, Artificial Sequence
  Description of Artificial Sequence: Synthetic peptide
  Seed: VSIVVLSGTTAAQVTTTEWVETTA (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWVETTA

SEQ ID NO: 340973 - protein, 24 aa, Artificial Sequence
  Description of Artificial Sequence: Synthetic peptide
  Seed: VSIVVLSGTTAAQVTTTEWVETTA (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWVETTA

SEQ ID NO: 340974 - protein, 24 aa, Artificial Sequence
  Description of Artificial Sequence: Synthetic peptide
  Seed: VSIVVLSGTTAAQVTTTEWVETTA (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWVETTA

SEQ ID NO: 340975 - protein, 24 aa, Artificial Sequence
  Description of Artificial Sequence: Synthetic peptide
  Seed: VSIVVLSGTTAAQVTTTEWVETTA (PMEL_HUMAN)
  Core: QVTTTEWVE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGTTAAXVTXTXWVXTTA

SEQ ID NO: 340976 - protein, 24 aa, Artificial Sequence
  Description of Artificial Sequence: Synthetic peptide
  Seed: VSIVVLSGTTAAQVTTTEWVETTA (PMEL_HUMAN)
  Core: VTTTEWVET
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGTTAAQXTTXEXVEXTA

SEQ ID NO: 340977 - protein, 25 aa, Artificial Sequence
  Description of Artificial Sequence: Synthetic peptide
  Seed: VSIVVLSGTTAAQVTTTEWVETTAR (PMEL_HUMAN)
  Core: IVVLSGTTA
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXVVXSXTTXAQVTTTEWVETTAR

SEQ ID NO: 340978 - protein, 25 aa, Artificial Sequence
  Description of Artificial Sequence: Synthetic peptide
  Seed: VSIVVLSGTTAAQVTTTEWVETTAR (PMEL_HUMAN)
  Core: VVLSGTTAA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSIXVLXGXTAXQVTTTEWVETTAR

SEQ ID NO: 340979 - protein, 25 aa, Artificial Sequence
  Description of Artificial Sequence: Synthetic peptide
  Seed: VSIVVLSGTTAAQVTTTEWVETTAR (PMEL_HUMAN)
  Core: VLSGTTAAQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSIVXLSXTXAAXVTTTEWVETTAR

SEQ ID NO: 340980 - protein, 25 aa, Artificial Sequence
  Description of Artificial Sequence: Synthetic peptide
  Seed: VSIVVLSGTTAAQVTTTEWVETTAR (PMEL_HUMAN)
  Core: LSGTTAAQV
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVXSGXTXAQXTTTEWVETTAR

SEQ ID NO: 340981 - protein, 25 aa, Artificial Sequence
  Description of Artificial Sequence: Synthetic peptide
  Seed: VSIVVLSGTTAAQVTTTEWVETTAR (PMEL_HUMAN)
  Core: TTAAQVTTT
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGXTAXQXTTXEWVETTAR

SEQ ID NO: 340982 - protein, 25 aa, Artificial Sequence
  Description of Artificial Sequence: Synthetic peptide
  Seed: VSIVVLSGTTAAQVTTTEWVETTAR (PMEL_HUMAN)
  Core: QVTTTEWVE
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGTTAAXVTXTXWVXTTAR

SEQ ID NO: 340983 - protein, 25 aa, Artificial Sequence
  Description of Artificial Sequence: Synthetic peptide
  Seed: VSIVVLSGTTAAQVTTTEWVETTAR (PMEL_HUMAN)
  Core: VTTTEWVET
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSIVVLSGTTAAQXTTXEXVEXTAR

SEQ ID NO: 340984 - protein, 14 aa, Artificial Sequence
  Description of Artificial Sequence: Synthetic peptide
  Seed: VSLADTNSLAVVST (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVST

SEQ ID NO: 340985 - protein, 14 aa, Artificial Sequence
  Description of Artificial Sequence: Synthetic peptide
  Seed: VSLADTNSLAVVST (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXT

SEQ ID NO: 340986 - protein, 14 aa, Artificial Sequence
  Description of Artificial Sequence: Synthetic peptide
  Seed: VSLADTNSLAVVST (PMEL_HUMAN)
  Core: TNSLAVVST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSLADXNSXAXVSX

SEQ ID NO: 340987 - protein, 15 aa, Artificial Sequence
  Description of Artificial Sequence: Synthetic peptide
  Seed: VSLADTNSLAVVSTQ (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQ

SEQ ID NO: 340988 - protein, 15 aa, Artificial Sequence
  Description of Artificial Sequence: Synthetic peptide
  Seed: VSLADTNSLAVVSTQ (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQ

SEQ ID NO: 340989 - protein, 15 aa, Artificial Sequence
  Description of Artificial Sequence: Synthetic peptide
  Seed: VSLADTNSLAVVSTQ (PMEL_HUMAN)
  Core: TNSLAVVST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSLADXNSXAXVSXQ

SEQ ID NO: 340990 - protein, 15 aa, Artificial Sequence
  Description of Artificial Sequence: Synthetic peptide
  Seed: VSLADTNSLAVVSTQ (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTX

SEQ ID NO: 340991 - protein, 16 aa, Artificial Sequence
  Description of Artificial Sequence: Synthetic peptide
  Seed: VSLADTNSLAVVSTQL (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQL

SEQ ID NO: 340992 - protein, 16 aa, Artificial Sequence
  Description of Artificial Sequence: Synthetic peptide
  Seed: VSLADTNSLAVVSTQL (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQL

SEQ ID NO: 340993 - protein, 16 aa, Artificial Sequence
  Description of Artificial Sequence: Synthetic peptide
  Seed: VSLADTNSLAVVSTQL (PMEL_HUMAN)
  Core: TNSLAVVST
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSLADXNSXAXVSXQL

SEQ ID NO: 340994 - protein, 16 aa, Artificial Sequence
  Description of Artificial Sequence: Synthetic peptide
  Seed: VSLADTNSLAVVSTQL (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXL

SEQ ID NO: 340995 - protein, 17 aa, Artificial Sequence
  Description of Artificial Sequence: Synthetic peptide
  Seed: VSLADTNSLAVVSTQLI (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQLI

SEQ ID NO: 340996 - protein, 17 aa, Artificial Sequence
  Description of Artificial Sequence: Synthetic peptide
  Seed: VSLADTNSLAVVSTQLI (PMEL_HUMAN)
  Core: ADTNSLAVV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSLXDTXSXAVXSTQLI

SEQ ID NO: 340997 - protein, 17 aa, Artificial Sequence
  Description of Artificial Sequence: Synthetic peptide
  Seed: VSLADTNSLAVVSTQLI (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQLI

SEQ ID NO: 340998 - protein, 17 aa, Artificial Sequence
  Description of Artificial Sequence: Synthetic peptide
  Seed: VSLADTNSLAVVSTQLI (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLI

SEQ ID NO: 340999 - protein, 17 aa, Artificial Sequence
  Description of Artificial Sequence: Synthetic peptide
  Seed: VSLADTNSLAVVSTQLI (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLX

SEQ ID NO: 341000 - protein, 18 aa, Artificial Sequence
  Description of Artificial Sequence: Synthetic peptide
  Seed: VSLADTNSLAVVSTQLIM (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQLIM

SEQ ID NO: 341001 - protein, 18 aa, Artificial Sequence
  Description of Artificial Sequence: Synthetic peptide
  Seed: VSLADTNSLAVVSTQLIM (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQLIM

SEQ ID NO: 341002 - protein, 18 aa, Artificial Sequence
  Description of Artificial Sequence: Synthetic peptide
  Seed: VSLADTNSLAVVSTQLIM (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIM

SEQ ID NO: 341003 - protein, 18 aa, Artificial Sequence
  Description of Artificial Sequence: Synthetic peptide
  Seed: VSLADTNSLAVVSTQLIM (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXM

SEQ ID NO: 341004 - protein, 19 aa, Artificial Sequence
  Description of Artificial Sequence: Synthetic peptide
  Seed: VSLADTNSLAVVSTQLIMP (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQLIMP

SEQ ID NO: 341005 - protein, 19 aa, Artificial Sequence
  Description of Artificial Sequence: Synthetic peptide
  Seed: VSLADTNSLAVVSTQLIMP (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQLIMP

SEQ ID NO: 341006 - protein, 19 aa, Artificial Sequence
  Description of Artificial Sequence: Synthetic peptide
  Seed: VSLADTNSLAVVSTQLIMP (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMP

SEQ ID NO: 341007 - protein, 19 aa, Artificial Sequence
  Description of Artificial Sequence: Synthetic peptide
  Seed: VSLADTNSLAVVSTQLIMP (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMP

SEQ ID NO: 341008 - protein, 20 aa, Artificial Sequence
  Description of Artificial Sequence: Synthetic peptide
  Seed: VSLADTNSLAVVSTQLIMPG (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQLIMPG

SEQ ID NO: 341009 - protein, 20 aa, Artificial Sequence
  Description of Artificial Sequence: Synthetic peptide
  Seed: VSLADTNSLAVVSTQLIMPG (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPG

SEQ ID NO: 341010 - protein, 20 aa, Artificial Sequence
  Description of Artificial Sequence: Synthetic peptide
  Seed: VSLADTNSLAVVSTQLIMPG (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPG

SEQ ID NO: 341011 - protein, 21 aa, Artificial Sequence
  Description of Artificial Sequence: Synthetic peptide
  Seed: VSLADTNSLAVVSTQLIMPGQ (PMEL_HUMAN)
  Core: LADTNSLAV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXADXNXLAXVSTQLIMPGQ

SEQ ID NO: 341012 - protein, 21 aa, Artificial Sequence
  Description of Artificial Sequence: Synthetic peptide
  Seed: VSLADTNSLAVVSTQLIMPGQ (PMEL_HUMAN)
  Core: DTNSLAVVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLAXTNXLXVVXTQLIMPGQ

SEQ ID NO: 341013 - protein, 21 aa, Artificial Sequence
  Description of Artificial Sequence: Synthetic peptide
  Seed: VSLADTNSLAVVSTQLIMPGQ (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPGQ

SEQ ID NO: 341014 - protein, 21 aa, Artificial Sequence
  Description of Artificial Sequence: Synthetic peptide
  Seed: VSLADTNSLAVVSTQLIMPGQ (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPGQ

SEQ ID NO: 341015 - protein, 21 aa, Artificial Sequence
  Description of Artificial Sequence: Synthetic peptide
  Seed: VSLADTNSLAVVSTQLIMPGQ (PMEL_HUMAN)
  Core: VSTQLIMPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVXSTXLXMPXQ

SEQ ID NO: 341016 - protein, 22 aa, Artificial Sequence
  Description of Artificial Sequence: Synthetic peptide
  Seed: VSLADTNSLAVVSTQLIMPGQE (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPGQE

SEQ ID NO: 341017 - protein, 22 aa, Artificial Sequence
  Description of Artificial Sequence: Synthetic peptide
  Seed: VSLADTNSLAVVSTQLIMPGQE (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPGQE

SEQ ID NO: 341018 - protein, 22 aa, Artificial Sequence
  Description of Artificial Sequence: Synthetic peptide
  Seed: VSLADTNSLAVVSTQLIMPGQE (PMEL_HUMAN)
  Core: VVSTQLIMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAXVSXQXIMXGQE

SEQ ID NO: 341019 - protein, 22 aa, Artificial Sequence
  Description of Artificial Sequence: Synthetic peptide
  Seed: VSLADTNSLAVVSTQLIMPGQE (PMEL_HUMAN)
  Core: VSTQLIMPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVXSTXLXMPXQE

SEQ ID NO: 341020 - protein, 23 aa, Artificial Sequence
  Description of Artificial Sequence: Synthetic peptide
  Seed: VSLADTNSLAVVSTQLIMPGQEA (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPGQEA

SEQ ID NO: 341021 - protein, 23 aa, Artificial Sequence
  Description of Artificial Sequence: Synthetic peptide
  Seed: VSLADTNSLAVVSTQLIMPGQEA (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPGQEA

SEQ ID NO: 341022 - protein, 23 aa, Artificial Sequence
  Description of Artificial Sequence: Synthetic peptide
  Seed: VSLADTNSLAVVSTQLIMPGQEA (PMEL_HUMAN)
  Core: VVSTQLIMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAXVSXQXIMXGQEA

SEQ ID NO: 341023 - protein, 23 aa, Artificial Sequence
  Description of Artificial Sequence: Synthetic peptide
  Seed: VSLADTNSLAVVSTQLIMPGQEA (PMEL_HUMAN)
  Core: VSTQLIMPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVXSTXLXMPXQEA

SEQ ID NO: 341024 - protein, 24 aa, Artificial Sequence
  Description of Artificial Sequence: Synthetic peptide
  Seed: VSLADTNSLAVVSTQLIMPGQEAG (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPGQEAG

SEQ ID NO: 341025 - protein, 24 aa, Artificial Sequence
  Description of Artificial Sequence: Synthetic peptide
  Seed: VSLADTNSLAVVSTQLIMPGQEAG (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPGQEAG

SEQ ID NO: 341026 - protein, 24 aa, Artificial Sequence
  Description of Artificial Sequence: Synthetic peptide
  Seed: VSLADTNSLAVVSTQLIMPGQEAG (PMEL_HUMAN)
  Core: VVSTQLIMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAXVSXQXIMXGQEAG

SEQ ID NO: 341027 - protein, 24 aa, Artificial Sequence
  Description of Artificial Sequence: Synthetic peptide
  Seed: VSLADTNSLAVVSTQLIMPGQEAG (PMEL_HUMAN)
  Core: VSTQLIMPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVXSTXLXMPXQEAG

SEQ ID NO: 341028 - protein, 25 aa, Artificial Sequence
  Description of Artificial Sequence: Synthetic peptide
  Seed: VSLADTNSLAVVSTQLIMPGQEAGL (PMEL_HUMAN)
  Core: NSLAVVSTQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTXSLXVXSTXLIMPGQEAGL

SEQ ID NO: 341029 - protein, 25 aa, Artificial Sequence
  Description of Artificial Sequence: Synthetic peptide
  Seed: VSLADTNSLAVVSTQLIMPGQEAGL (PMEL_HUMAN)
  Core: LAVVSTQLI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSXAVXSXQLXMPGQEAGL

SEQ ID NO: 341030 - protein, 25 aa, Artificial Sequence
  Description of Artificial Sequence: Synthetic peptide
  Seed: VSLADTNSLAVVSTQLIMPGQEAGL (PMEL_HUMAN)
  Core: VVSTQLIMP
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAXVSXQXIMXGQEAGL

SEQ ID NO: 341031 - protein, 25 aa, Artificial Sequence
  Description of Artificial Sequence: Synthetic peptide
  Seed: VSLADTNSLAVVSTQLIMPGQEAGL (PMEL_HUMAN)
  Core: VSTQLIMPG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVXSTXLXMPXQEAGL

SEQ ID NO: 341032 - protein, 25 aa, Artificial Sequence
  Description of Artificial Sequence: Synthetic peptide
  Seed: VSLADTNSLAVVSTQLIMPGQEAGL (PMEL_HUMAN)
  Core: QLIMPGQEA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSLADTNSLAVVSTXLIXPXQEXGL

SEQ ID NO: 341033 - protein, 15 aa, Artificial Sequence
  Description of Artificial Sequence: Synthetic peptide
  Seed: VSLKVSNDGPTLIGA (PMEL_HUMAN)
  Core: VSNDGPTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLKXSNXGXTLXGA

SEQ ID NO: 341034 - protein, 16 aa, Artificial Sequence
  Description of Artificial Sequence: Synthetic peptide
  Seed: VSLKVSNDGPTLIGAN (PMEL_HUMAN)
  Core: VSNDGPTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLKXSNXGXTLXGAN

SEQ ID NO: 341035 - protein, 19 aa, Artificial Sequence
  Description of Artificial Sequence: Synthetic peptide
  Seed: VSLKVSNDGPTLIGANASF (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXF

SEQ ID NO: 341036 - protein, 20 aa, Artificial Sequence
  Description of Artificial Sequence: Synthetic peptide
  Seed: VSLKVSNDGPTLIGANASFS (PMEL_HUMAN)
  Core: VSNDGPTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLKXSNXGXTLXGANASFS

SEQ ID NO: 341037 - protein, 20 aa, Artificial Sequence
  Description of Artificial Sequence: Synthetic peptide
  Seed: VSLKVSNDGPTLIGANASFS (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFS

SEQ ID NO: 341038 - protein, 20 aa, Artificial Sequence
  Description of Artificial Sequence: Synthetic peptide
  Seed: VSLKVSNDGPTLIGANASFS (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFX

SEQ ID NO: 341039 - protein, 21 aa, Artificial Sequence
  Description of Artificial Sequence: Synthetic peptide
  Seed: VSLKVSNDGPTLIGANASFSI (PMEL_HUMAN)
  Core: VSNDGPTLI
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSLKXSNXGXTLXGANASFSI

SEQ ID NO: 341040 - protein, 21 aa, Artificial Sequence
  Description of Artificial Sequence: Synthetic peptide
  Seed: VSLKVSNDGPTLIGANASFSI (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFSI

SEQ ID NO: 341041 - protein, 21 aa, Artificial Sequence
  Description of Artificial Sequence: Synthetic peptide
  Seed: VSLKVSNDGPTLIGANASFSI (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFXI

SEQ ID NO: 341042 - protein, 21 aa, Artificial Sequence
  Description of Artificial Sequence: Synthetic peptide
  Seed: VSLKVSNDGPTLIGANASFSI (PMEL_HUMAN)
  Core: IGANASFSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTLXGAXAXFSX

SEQ ID NO: 341043 - protein, 22 aa, Artificial Sequence
  Description of Artificial Sequence: Synthetic peptide
  Seed: VSLKVSNDGPTLIGANASFSIA (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFSIA

SEQ ID NO: 341044 - protein, 22 aa, Artificial Sequence
  Description of Artificial Sequence: Synthetic peptide
  Seed: VSLKVSNDGPTLIGANASFSIA (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFXIA

SEQ ID NO: 341045 - protein, 22 aa, Artificial Sequence
  Description of Artificial Sequence: Synthetic peptide
  Seed: VSLKVSNDGPTLIGANASFSIA (PMEL_HUMAN)
  Core: IGANASFSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTLXGAXAXFSXA

SEQ ID NO: 341046 - protein, 23 aa, Artificial Sequence
  Description of Artificial Sequence: Synthetic peptide
  Seed: VSLKVSNDGPTLIGANASFSIAL (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFSIAL

SEQ ID NO: 341047 - protein, 23 aa, Artificial Sequence
  Description of Artificial Sequence: Synthetic peptide
  Seed: VSLKVSNDGPTLIGANASFSIAL (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFXIAL

SEQ ID NO: 341048 - protein, 23 aa, Artificial Sequence
  Description of Artificial Sequence: Synthetic peptide
  Seed: VSLKVSNDGPTLIGANASFSIAL (PMEL_HUMAN)
  Core: IGANASFSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTLXGAXAXFSXAL

SEQ ID NO: 341049 - protein, 24 aa, Artificial Sequence
  Description of Artificial Sequence: Synthetic peptide
  Seed: VSLKVSNDGPTLIGANASFSIALN (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFSIALN

SEQ ID NO: 341050 - protein, 24 aa, Artificial Sequence
  Description of Artificial Sequence: Synthetic peptide
  Seed: VSLKVSNDGPTLIGANASFSIALN (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFXIALN

SEQ ID NO: 341051 - protein, 24 aa, Artificial Sequence
  Description of Artificial Sequence: Synthetic peptide
  Seed: VSLKVSNDGPTLIGANASFSIALN (PMEL_HUMAN)
  Core: IGANASFSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTLXGAXAXFSXALN

SEQ ID NO: 341052 - protein, 25 aa, Artificial Sequence
  Description of Artificial Sequence: Synthetic peptide
  Seed: VSLKVSNDGPTLIGANASFSIALNF (PMEL_HUMAN)
  Core: PTLIGANAS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGXTLXGXNAXFSIALNF

SEQ ID NO: 341053 - protein, 25 aa, Artificial Sequence
  Description of Artificial Sequence: Synthetic peptide
  Seed: VSLKVSNDGPTLIGANASFSIALNF (PMEL_HUMAN)
  Core: LIGANASFS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTXIGXNXSFXIALNF

SEQ ID NO: 341054 - protein, 25 aa, Artificial Sequence
  Description of Artificial Sequence: Synthetic peptide
  Seed: VSLKVSNDGPTLIGANASFSIALNF (PMEL_HUMAN)
  Core: IGANASFSI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSLKVSNDGPTLXGAXAXFSXALNF

SEQ ID NO: 341055 - protein, 15 aa, Artificial Sequence
  Description of Artificial Sequence: Synthetic peptide
  Seed: VSNDGPTLIGANASF (PMEL_HUMAN)
  Core: DGPTLIGAN
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSNXGPXLXGAXASF

SEQ ID NO: 341056 - protein, 15 aa, Artificial Sequence
  Description of Artificial Sequence: Synthetic peptide
  Seed: VSNDGPTLIGANASF (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXF

SEQ ID NO: 341057 - protein, 16 aa, Artificial Sequence
  Description of Artificial Sequence: Synthetic peptide
  Seed: VSNDGPTLIGANASFS (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFS

SEQ ID NO: 341058 - protein, 16 aa, Artificial Sequence
  Description of Artificial Sequence: Synthetic peptide
  Seed: VSNDGPTLIGANASFS (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFX

SEQ ID NO: 341059 - protein, 17 aa, Artificial Sequence
  Description of Artificial Sequence: Synthetic peptide
  Seed: VSNDGPTLIGANASFSI (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSI

SEQ ID NO: 341060 - protein, 17 aa, Artificial Sequence
  Description of Artificial Sequence: Synthetic peptide
  Seed: VSNDGPTLIGANASFSI (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXI

SEQ ID NO: 341061 - protein, 17 aa, Artificial Sequence
  Description of Artificial Sequence: Synthetic peptide
  Seed: VSNDGPTLIGANASFSI (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSX

SEQ ID NO: 341062 - protein, 18 aa, Artificial Sequence
  Description of Artificial Sequence: Synthetic peptide
  Seed: VSNDGPTLIGANASFSIA (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIA

SEQ ID NO: 341063 - protein, 18 aa, Artificial Sequence
  Description of Artificial Sequence: Synthetic peptide
  Seed: VSNDGPTLIGANASFSIA (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIA

SEQ ID NO: 341064 - protein, 18 aa, Artificial Sequence
  Description of Artificial Sequence: Synthetic peptide
  Seed: VSNDGPTLIGANASFSIA (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXA

SEQ ID NO: 341065 - protein, 19 aa, Artificial Sequence
  Description of Artificial Sequence: Synthetic peptide
  Seed: VSNDGPTLIGANASFSIAL (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIAL

SEQ ID NO: 341066 - protein, 19 aa, Artificial Sequence
  Description of Artificial Sequence: Synthetic peptide
  Seed: VSNDGPTLIGANASFSIAL (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIAL

SEQ ID NO: 341067 - protein, 19 aa, Artificial Sequence
  Description of Artificial Sequence: Synthetic peptide
  Seed: VSNDGPTLIGANASFSIAL (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXAL

SEQ ID NO: 341068 - protein, 20 aa, Artificial Sequence
  Description of Artificial Sequence: Synthetic peptide
  Seed: VSNDGPTLIGANASFSIALN (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALN

SEQ ID NO: 341069 - protein, 20 aa, Artificial Sequence
  Description of Artificial Sequence: Synthetic peptide
  Seed: VSNDGPTLIGANASFSIALN (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALN

SEQ ID NO: 341070 - protein, 20 aa, Artificial Sequence
  Description of Artificial Sequence: Synthetic peptide
  Seed: VSNDGPTLIGANASFSIALN (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALN

SEQ ID NO: 341071 - protein, 21 aa, Artificial Sequence
  Description of Artificial Sequence: Synthetic peptide
  Seed: VSNDGPTLIGANASFSIALNF (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALNF

SEQ ID NO: 341072 - protein, 21 aa, Artificial Sequence
  Description of Artificial Sequence: Synthetic peptide
  Seed: VSNDGPTLIGANASFSIALNF (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALNF

SEQ ID NO: 341073 - protein, 21 aa, Artificial Sequence
  Description of Artificial Sequence: Synthetic peptide
  Seed: VSNDGPTLIGANASFSIALNF (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALNF

SEQ ID NO: 341074 - protein, 21 aa, Artificial Sequence
  Description of Artificial Sequence: Synthetic peptide
  Seed: VSNDGPTLIGANASFSIALNF (PMEL_HUMAN)
  Core: NASFSIALN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGAXASXSXALXF

SEQ ID NO: 341075 - protein, 22 aa, Artificial Sequence
  Description of Artificial Sequence: Synthetic peptide
  Seed: VSNDGPTLIGANASFSIALNFP (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALNFP

SEQ ID NO: 341076 - protein, 22 aa, Artificial Sequence
  Description of Artificial Sequence: Synthetic peptide
  Seed: VSNDGPTLIGANASFSIALNFP (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALNFP

SEQ ID NO: 341077 - protein, 22 aa, Artificial Sequence
  Description of Artificial Sequence: Synthetic peptide
  Seed: VSNDGPTLIGANASFSIALNFP (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALNFP

SEQ ID NO: 341078 - protein, 22 aa, Artificial Sequence
  Description of Artificial Sequence: Synthetic peptide
  Seed: VSNDGPTLIGANASFSIALNFP (PMEL_HUMAN)
  Core: NASFSIALN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGAXASXSXALXFP

SEQ ID NO: 341079 - protein, 23 aa, Artificial Sequence
  Description of Artificial Sequence: Synthetic peptide
  Seed: VSNDGPTLIGANASFSIALNFPG (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALNFPG

SEQ ID NO: 341080 - protein, 23 aa, Artificial Sequence
  Description of Artificial Sequence: Synthetic peptide
  Seed: VSNDGPTLIGANASFSIALNFPG (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALNFPG

SEQ ID NO: 341081 - protein, 23 aa, Artificial Sequence
  Description of Artificial Sequence: Synthetic peptide
  Seed: VSNDGPTLIGANASFSIALNFPG (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALNFPG

SEQ ID NO: 341082 - protein, 23 aa, Artificial Sequence
  Description of Artificial Sequence: Synthetic peptide
  Seed: VSNDGPTLIGANASFSIALNFPG (PMEL_HUMAN)
  Core: NASFSIALN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGAXASXSXALXFPG

SEQ ID NO: 341083 - protein, 23 aa, Artificial Sequence
  Description of Artificial Sequence: Synthetic peptide
  Seed: VSNDGPTLIGANASFSIALNFPG (PMEL_HUMAN)
  Core: FSIALNFPG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGANASXSIXLXFPX

SEQ ID NO: 341084 - protein, 24 aa, Artificial Sequence
  Description of Artificial Sequence: Synthetic peptide
  Seed: VSNDGPTLIGANASFSIALNFPGS (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALNFPGS

SEQ ID NO: 341085 - protein, 24 aa, Artificial Sequence
  Description of Artificial Sequence: Synthetic peptide
  Seed: VSNDGPTLIGANASFSIALNFPGS (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALNFPGS

SEQ ID NO: 341086 - protein, 24 aa, Artificial Sequence
  Description of Artificial Sequence: Synthetic peptide
  Seed: VSNDGPTLIGANASFSIALNFPGS (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALNFPGS

SEQ ID NO: 341087 - protein, 24 aa, Artificial Sequence
  Description of Artificial Sequence: Synthetic peptide
  Seed: VSNDGPTLIGANASFSIALNFPGS (PMEL_HUMAN)
  Core: NASFSIALN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGAXASXSXALXFPGS

SEQ ID NO: 341088 - protein, 24 aa, Artificial Sequence
  Description of Artificial Sequence: Synthetic peptide
  Seed: VSNDGPTLIGANASFSIALNFPGS (PMEL_HUMAN)
  Core: ASFSIALNF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGANXSFXIXLNXPGS

SEQ ID NO: 341089 - protein, 24 aa, Artificial Sequence
  Description of Artificial Sequence: Synthetic peptide
  Seed: VSNDGPTLIGANASFSIALNFPGS (PMEL_HUMAN)
  Core: FSIALNFPG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGANASXSIXLXFPXS

SEQ ID NO: 341090 - protein, 25 aa, Artificial Sequence
  Description of Artificial Sequence: Synthetic peptide
  Seed: VSNDGPTLIGANASFSIALNFPGSQ (PMEL_HUMAN)
  Core: PTLIGANAS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGXTLXGXNAXFSIALNFPGSQ

SEQ ID NO: 341091 - protein, 25 aa, Artificial Sequence
  Description of Artificial Sequence: Synthetic peptide
  Seed: VSNDGPTLIGANASFSIALNFPGSQ (PMEL_HUMAN)
  Core: LIGANASFS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTXIGXNXSFXIALNFPGSQ

SEQ ID NO: 341092 - protein, 25 aa, Artificial Sequence
  Description of Artificial Sequence: Synthetic peptide
  Seed: VSNDGPTLIGANASFSIALNFPGSQ (PMEL_HUMAN)
  Core: IGANASFSI
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLXGAXAXFSXALNFPGSQ

SEQ ID NO: 341093 - protein, 25 aa, Artificial Sequence
  Description of Artificial Sequence: Synthetic peptide
  Seed: VSNDGPTLIGANASFSIALNFPGSQ (PMEL_HUMAN)
  Core: NASFSIALN
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGAXASXSXALXFPGSQ

SEQ ID NO: 341094 - protein, 25 aa, Artificial Sequence
  Description of Artificial Sequence: Synthetic peptide
  Seed: VSNDGPTLIGANASFSIALNFPGSQ (PMEL_HUMAN)
  Core: ASFSIALNF
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGANXSFXIXLNXPGSQ

SEQ ID NO: 341095 - protein, 25 aa, Artificial Sequence
  Description of Artificial Sequence: Synthetic peptide
  Seed: VSNDGPTLIGANASFSIALNFPGSQ (PMEL_HUMAN)
  Core: FSIALNFPG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSNDGPTLIGANASXSIXLXFPXSQ

SEQ ID NO: 341096 - protein, 15 aa, Artificial Sequence
  Description of Artificial Sequence: Synthetic peptide
  Seed: VSQLRALDGGNKHFL (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFL

SEQ ID NO: 341097 - protein, 16 aa, Artificial Sequence
  Description of Artificial Sequence: Synthetic peptide
  Seed: VSQLRALDGGNKHFLR (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFLR

SEQ ID NO: 341098 - protein, 17 aa, Artificial Sequence
  Description of Artificial Sequence: Synthetic peptide
  Seed: VSQLRALDGGNKHFLRN (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFLRN

SEQ ID NO: 341099 - protein, 20 aa, Artificial Sequence
  Description of Artificial Sequence: Synthetic peptide
  Seed: VSQLRALDGGNKHFLRNQPL (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFLRNQPL

SEQ ID NO: 341100 - protein, 21 aa, Artificial Sequence
  Description of Artificial Sequence: Synthetic peptide
  Seed: VSQLRALDGGNKHFLRNQPLT (PMEL_HUMAN)
  Core: KHFLRNQPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNXHFXRXQPXT

SEQ ID NO: 341101 - protein, 22 aa, Artificial Sequence
  Description of Artificial Sequence: Synthetic peptide
  Seed: VSQLRALDGGNKHFLRNQPLTF (PMEL_HUMAN)
  Core: LDGGNKHFL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRAXDGXNXHFXRNQPLTF

SEQ ID NO: 341102 - protein, 22 aa, Artificial Sequence
  Description of Artificial Sequence: Synthetic peptide
  Seed: VSQLRALDGGNKHFLRNQPLTF (PMEL_HUMAN)
  Core: KHFLRNQPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNXHFXRXQPXTF

SEQ ID NO: 341103 - protein, 22 aa, Artificial Sequence
  Description of Artificial Sequence: Synthetic peptide
  Seed: VSQLRALDGGNKHFLRNQPLTF (PMEL_HUMAN)
  Core: FLRNQPLTF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHXLRXQXLTX

SEQ ID NO: 341104 - protein, 23 aa, Artificial Sequence
  Description of Artificial Sequence: Synthetic peptide
  Seed: VSQLRALDGGNKHFLRNQPLTFA (PMEL_HUMAN)
  Core: LDGGNKHFL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRAXDGXNXHFXRNQPLTFA

SEQ ID NO: 341105 - protein, 23 aa, Artificial Sequence
  Description of Artificial Sequence: Synthetic peptide
  Seed: VSQLRALDGGNKHFLRNQPLTFA (PMEL_HUMAN)
  Core: GGNKHFLRN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDXGNXHXLRXQPLTFA

SEQ ID NO: 341106 - protein, 23 aa, Artificial Sequence
  Description of Artificial Sequence: Synthetic peptide
  Seed: VSQLRALDGGNKHFLRNQPLTFA (PMEL_HUMAN)
  Core: KHFLRNQPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNXHFXRXQPXTFA

SEQ ID NO: 341107 - protein, 23 aa, Artificial Sequence
  Description of Artificial Sequence: Synthetic peptide
  Seed: VSQLRALDGGNKHFLRNQPLTFA (PMEL_HUMAN)
  Core: FLRNQPLTF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHXLRXQXLTXA

SEQ ID NO: 341108 - protein, 24 aa, Artificial Sequence
  Description of Artificial Sequence: Synthetic peptide
  Seed: VSQLRALDGGNKHFLRNQPLTFAL (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFLRNQPLTFAL

SEQ ID NO: 341109 - protein, 24 aa, Artificial Sequence
  Description of Artificial Sequence: Synthetic peptide
  Seed: VSQLRALDGGNKHFLRNQPLTFAL (PMEL_HUMAN)
  Core: LDGGNKHFL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRAXDGXNXHFXRNQPLTFAL

SEQ ID NO: 341110 - protein, 24 aa, Artificial Sequence
  Description of Artificial Sequence: Synthetic peptide
  Seed: VSQLRALDGGNKHFLRNQPLTFAL (PMEL_HUMAN)
  Core: GGNKHFLRN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDXGNXHXLRXQPLTFAL

SEQ ID NO: 341111 - protein, 24 aa, Artificial Sequence
  Description of Artificial Sequence: Synthetic peptide
  Seed: VSQLRALDGGNKHFLRNQPLTFAL (PMEL_HUMAN)
  Core: KHFLRNQPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNXHFXRXQPXTFAL

SEQ ID NO: 341112 - protein, 24 aa, Artificial Sequence
  Description of Artificial Sequence: Synthetic peptide
  Seed: VSQLRALDGGNKHFLRNQPLTFAL (PMEL_HUMAN)
  Core: FLRNQPLTF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHXLRXQXLTXAL

SEQ ID NO: 341113 - protein, 24 aa, Artificial Sequence
  Description of Artificial Sequence: Synthetic peptide
  Seed: VSQLRALDGGNKHFLRNQPLTFAL (PMEL_HUMAN)
  Core: LRNQPLTFA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHFXRNXPXTFXL

SEQ ID NO: 341114 - protein, 25 aa, Artificial Sequence
  Description of Artificial Sequence: Synthetic peptide
  Seed: VSQLRALDGGNKHFLRNQPLTFALQ (PMEL_HUMAN)
  Core: LRALDGGNK
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSQXRAXDXGNXHFLRNQPLTFALQ

SEQ ID NO: 341115 - protein, 25 aa, Artificial Sequence
  Description of Artificial Sequence: Synthetic peptide
  Seed: VSQLRALDGGNKHFLRNQPLTFALQ (PMEL_HUMAN)
  Core: RALDGGNKH
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSQLXALXGXNKXFLRNQPLTFALQ

SEQ ID NO: 341116 - protein, 25 aa, Artificial Sequence
  Description of Artificial Sequence: Synthetic peptide
  Seed: VSQLRALDGGNKHFLRNQPLTFALQ (PMEL_HUMAN)
  Core: LDGGNKHFL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRAXDGXNXHFXRNQPLTFALQ

SEQ ID NO: 341117 - protein, 25 aa, Artificial Sequence
  Description of Artificial Sequence: Synthetic peptide
  Seed: VSQLRALDGGNKHFLRNQPLTFALQ (PMEL_HUMAN)
  Core: GGNKHFLRN
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDXGNXHXLRXQPLTFALQ

SEQ ID NO: 341118 - protein, 25 aa, Artificial Sequence
  Description of Artificial Sequence: Synthetic peptide
  Seed: VSQLRALDGGNKHFLRNQPLTFALQ (PMEL_HUMAN)
  Core: KHFLRNQPL
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNXHFXRXQPXTFALQ

SEQ ID NO: 341119 - protein, 25 aa, Artificial Sequence
  Description of Artificial Sequence: Synthetic peptide
  Seed: VSQLRALDGGNKHFLRNQPLTFALQ (PMEL_HUMAN)
  Core: FLRNQPLTF
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHXLRXQXLTXALQ

SEQ ID NO: 341120 - protein, 25 aa, Artificial Sequence
  Description of Artificial Sequence: Synthetic peptide
  Seed: VSQLRALDGGNKHFLRNQPLTFALQ (PMEL_HUMAN)
  Core: LRNQPLTFA
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VSQLRALDGGNKHFXRNXPXTFXLQ

SEQ ID NO: 341121 - protein, 14 aa, Artificial Sequence
  Description of Artificial Sequence: Synthetic peptide
  Seed: VSRQLRTKAWNRQL (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXL

SEQ ID NO: 341122 - protein, 15 aa, Artificial Sequence
  Description of Artificial Sequence: Synthetic peptide
  Seed: VSRQLRTKAWNRQLY (PMEL_HUMAN)
  Core: QLRTKAWNR
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSRXLRXKXWNXQLY

SEQ ID NO: 341123 - protein, 15 aa, Artificial Sequence
  Description of Artificial Sequence: Synthetic peptide
  Seed: VSRQLRTKAWNRQLY (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLY

SEQ ID NO: 341124 - protein, 15 aa, Artificial Sequence
  Description of Artificial Sequence: Synthetic peptide
  Seed: VSRQLRTKAWNRQLY (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLX

SEQ ID NO: 341125 - protein, 16 aa, Artificial Sequence
  Description of Artificial Sequence: Synthetic peptide
  Seed: VSRQLRTKAWNRQLYP (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYP

SEQ ID NO: 341126 - protein, 16 aa, Artificial Sequence
  Description of Artificial Sequence: Synthetic peptide
  Seed: VSRQLRTKAWNRQLYP (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXP

SEQ ID NO: 341127 - protein, 17 aa, Artificial Sequence
  Description of Artificial Sequence: Synthetic peptide
  Seed: VSRQLRTKAWNRQLYPE (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPE

SEQ ID NO: 341128 - protein, 17 aa, Artificial Sequence
  Description of Artificial Sequence: Synthetic peptide
  Seed: VSRQLRTKAWNRQLYPE (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPE

SEQ ID NO: 341129 - protein, 18 aa, Artificial Sequence
  Description of Artificial Sequence: Synthetic peptide
  Seed: VSRQLRTKAWNRQLYPEW (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEW

SEQ ID NO: 341130 - protein, 19 aa, Artificial Sequence
  Description of Artificial Sequence: Synthetic peptide
  Seed: VSRQLRTKAWNRQLYPEWT (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWT

SEQ ID NO: 341131 - protein, 19 aa, Artificial Sequence
  Description of Artificial Sequence: Synthetic peptide
  Seed: VSRQLRTKAWNRQLYPEWT (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWT

SEQ ID NO: 341132 - protein, 20 aa, Artificial Sequence
  Description of Artificial Sequence: Synthetic peptide
  Seed: VSRQLRTKAWNRQLYPEWTE (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTE

SEQ ID NO: 341133 - protein, 20 aa, Artificial Sequence
  Description of Artificial Sequence: Synthetic peptide
  Seed: VSRQLRTKAWNRQLYPEWTE (PMEL_HUMAN)
  Core: RTKAWNRQL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLXTKXWXRQXYPEWTE

SEQ ID NO: 341134 - protein, 20 aa, Artificial Sequence
  Description of Artificial Sequence: Synthetic peptide
  Seed: VSRQLRTKAWNRQLYPEWTE (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTE

SEQ ID NO: 341135 - protein, 21 aa, Artificial Sequence
  Description of Artificial Sequence: Synthetic peptide
  Seed: VSRQLRTKAWNRQLYPEWTEA (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTEA

SEQ ID NO: 341136 - protein, 21 aa, Artificial Sequence
  Description of Artificial Sequence: Synthetic peptide
  Seed: VSRQLRTKAWNRQLYPEWTEA (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTEA

SEQ ID NO: 341137 - protein, 22 aa, Artificial Sequence
  Description of Artificial Sequence: Synthetic peptide
  Seed: VSRQLRTKAWNRQLYPEWTEAQ (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTEAQ

SEQ ID NO: 341138 - protein, 22 aa, Artificial Sequence
  Description of Artificial Sequence: Synthetic peptide
  Seed: VSRQLRTKAWNRQLYPEWTEAQ (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTEAQ

SEQ ID NO: 341139 - protein, 22 aa, Artificial Sequence
  Description of Artificial Sequence: Synthetic peptide
  Seed: VSRQLRTKAWNRQLYPEWTEAQ (PMEL_HUMAN)
  Core: NRQLYPEWT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWXRQXYXEWXEAQ

SEQ ID NO: 341140 - protein, 23 aa, Artificial Sequence
  Description of Artificial Sequence: Synthetic peptide
  Seed: VSRQLRTKAWNRQLYPEWTEAQR (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTEAQR

SEQ ID NO: 341141 - protein, 23 aa, Artificial Sequence
  Description of Artificial Sequence: Synthetic peptide
  Seed: VSRQLRTKAWNRQLYPEWTEAQR (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTEAQR

SEQ ID NO: 341142 - protein, 23 aa, Artificial Sequence
  Description of Artificial Sequence: Synthetic peptide
  Seed: VSRQLRTKAWNRQLYPEWTEAQR (PMEL_HUMAN)
  Core: NRQLYPEWT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWXRQXYXEWXEAQR

SEQ ID NO: 341143 - protein, 23 aa, Artificial Sequence
  Description of Artificial Sequence: Synthetic peptide
  Seed: VSRQLRTKAWNRQLYPEWTEAQR (PMEL_HUMAN)
  Core: LYPEWTEAQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWNRQXYPXWXEAXR

SEQ ID NO: 341144 - protein, 24 aa, Artificial Sequence
  Description of Artificial Sequence: Synthetic peptide
  Seed: VSRQLRTKAWNRQLYPEWTEAQRL (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTEAQRL

SEQ ID NO: 341145 - protein, 24 aa, Artificial Sequence
  Description of Artificial Sequence: Synthetic peptide
  Seed: VSRQLRTKAWNRQLYPEWTEAQRL (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTEAQRL

SEQ ID NO: 341146 - protein, 24 aa, Artificial Sequence
  Description of Artificial Sequence: Synthetic peptide
  Seed: VSRQLRTKAWNRQLYPEWTEAQRL (PMEL_HUMAN)
  Core: NRQLYPEWT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWXRQXYXEWXEAQRL

SEQ ID NO: 341147 - protein, 24 aa, Artificial Sequence
  Description of Artificial Sequence: Synthetic peptide
  Seed: VSRQLRTKAWNRQLYPEWTEAQRL (PMEL_HUMAN)
  Core: LYPEWTEAQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWNRQXYPXWXEAXRL

SEQ ID NO: 341148 - protein, 25 aa, Artificial Sequence
  Description of Artificial Sequence: Synthetic peptide
  Seed: VSRQLRTKAWNRQLYPEWTEAQRLD (PMEL_HUMAN)
  Core: LRTKAWNRQ
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VSRQXRTXAXNRXLYPEWTEAQRLD

SEQ ID NO: 341149 - protein, 25 aa, Artificial Sequence
  Description of Artificial Sequence: Synthetic peptide
  Seed: VSRQLRTKAWNRQLYPEWTEAQRLD (PMEL_HUMAN)
  Core: TKAWNRQLY
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRXKAXNXQLXPEWTEAQRLD

SEQ ID NO: 341150 - protein, 25 aa, Artificial Sequence
  Description of Artificial Sequence: Synthetic peptide
  Seed: VSRQLRTKAWNRQLYPEWTEAQRLD (PMEL_HUMAN)
  Core: LYPEWTEAQ
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSRQLRTKAWNRQXYPXWXEAXRLD

SEQ ID NO: 341151 - protein, 14 aa, Artificial Sequence
  Description of Artificial Sequence: Synthetic peptide
  Seed: VSTQLIMPGQEAGL (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGL

SEQ ID NO: 341152 - protein, 15 aa, Artificial Sequence
  Description of Artificial Sequence: Synthetic peptide
  Seed: VSTQLIMPGQEAGLG (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLG

SEQ ID NO: 341153 - protein, 15 aa, Artificial Sequence
  Description of Artificial Sequence: Synthetic peptide
  Seed: VSTQLIMPGQEAGLG (PMEL_HUMAN)
  Core: IMPGQEAGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLXMPXQXAGXG

SEQ ID NO: 341154 - protein, 16 aa, Artificial Sequence
  Description of Artificial Sequence: Synthetic peptide
  Seed: VSTQLIMPGQEAGLGQ (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQ

SEQ ID NO: 341155 - protein, 16 aa, Artificial Sequence
  Description of Artificial Sequence: Synthetic peptide
  Seed: VSTQLIMPGQEAGLGQ (PMEL_HUMAN)
  Core: IMPGQEAGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLXMPXQXAGXGQ

SEQ ID NO: 341156 - protein, 17 aa, Artificial Sequence
  Description of Artificial Sequence: Synthetic peptide
  Seed: VSTQLIMPGQEAGLGQV (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQV

SEQ ID NO: 341157 - protein, 20 aa, Artificial Sequence
  Description of Artificial Sequence: Synthetic peptide
  Seed: VSTQLIMPGQEAGLGQVPLI (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLI

SEQ ID NO: 341158 - protein, 20 aa, Artificial Sequence
  Description of Artificial Sequence: Synthetic peptide
  Seed: VSTQLIMPGQEAGLGQVPLI (PMEL_HUMAN)
  Core: IMPGQEAGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLXMPXQXAGXGQVPLI

SEQ ID NO: 341159 - protein, 21 aa, Artificial Sequence
  Description of Artificial Sequence: Synthetic peptide
  Seed: VSTQLIMPGQEAGLGQVPLIV (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLIV

SEQ ID NO: 341160 - protein, 21 aa, Artificial Sequence
  Description of Artificial Sequence: Synthetic peptide
  Seed: VSTQLIMPGQEAGLGQVPLIV (PMEL_HUMAN)
  Core: IMPGQEAGL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLXMPXQXAGXGQVPLIV

SEQ ID NO: 341161 - protein, 22 aa, Artificial Sequence
  Description of Artificial Sequence: Synthetic peptide
  Seed: VSTQLIMPGQEAGLGQVPLIVG (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLIVG

SEQ ID NO: 341162 - protein, 22 aa, Artificial Sequence
  Description of Artificial Sequence: Synthetic peptide
  Seed: VSTQLIMPGQEAGLGQVPLIVG (PMEL_HUMAN)
  Core: AGLGQVPLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEXGLXQXPLXVG

SEQ ID NO: 341163 - protein, 23 aa, Artificial Sequence
  Description of Artificial Sequence: Synthetic peptide
  Seed: VSTQLIMPGQEAGLGQVPLIVGI (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLIVGI

SEQ ID NO: 341164 - protein, 23 aa, Artificial Sequence
  Description of Artificial Sequence: Synthetic peptide
  Seed: VSTQLIMPGQEAGLGQVPLIVGI (PMEL_HUMAN)
  Core: AGLGQVPLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEXGLXQXPLXVGI

SEQ ID NO: 341165 - protein, 23 aa, Artificial Sequence
  Description of Artificial Sequence: Synthetic peptide
  Seed: VSTQLIMPGQEAGLGQVPLIVGI (PMEL_HUMAN)
  Core: LGQVPLIVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEAGXGQXPXIVXI

SEQ ID NO: 341166 - protein, 24 aa, Artificial Sequence
  Description of Artificial Sequence: Synthetic peptide
  Seed: VSTQLIMPGQEAGLGQVPLIVGIL (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLIVGIL

SEQ ID NO: 341167 - protein, 24 aa, Artificial Sequence
  Description of Artificial Sequence: Synthetic peptide
  Seed: VSTQLIMPGQEAGLGQVPLIVGIL (PMEL_HUMAN)
  Core: AGLGQVPLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEXGLXQXPLXVGIL

SEQ ID NO: 341168 - protein, 24 aa, Artificial Sequence
  Description of Artificial Sequence: Synthetic peptide
  Seed: VSTQLIMPGQEAGLGQVPLIVGIL (PMEL_HUMAN)
  Core: GLGQVPLIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEAXLGXVXLIXGIL

SEQ ID NO: 341169 - protein, 24 aa, Artificial Sequence
  Description of Artificial Sequence: Synthetic peptide
  Seed: VSTQLIMPGQEAGLGQVPLIVGIL (PMEL_HUMAN)
  Core: LGQVPLIVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEAGXGQXPXIVXIL

SEQ ID NO: 341170 - protein, 25 aa, Artificial Sequence
  Description of Artificial Sequence: Synthetic peptide
  Seed: VSTQLIMPGQEAGLGQVPLIVGILL (PMEL_HUMAN)
  Core: QLIMPGQEA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VSTXLIXPXQEXGLGQVPLIVGILL

SEQ ID NO: 341171 - protein, 25 aa, Artificial Sequence
  Description of Artificial Sequence: Synthetic peptide
  Seed: VSTQLIMPGQEAGLGQVPLIVGILL (PMEL_HUMAN)
  Core: AGLGQVPLI
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEXGLXQXPLXVGILL

SEQ ID NO: 341172 - protein, 25 aa, Artificial Sequence
  Description of Artificial Sequence: Synthetic peptide
  Seed: VSTQLIMPGQEAGLGQVPLIVGILL (PMEL_HUMAN)
  Core: GLGQVPLIV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEAXLGXVXLIXGILL

SEQ ID NO: 341173 - protein, 25 aa, Artificial Sequence
  Description of Artificial Sequence: Synthetic peptide
  Seed: VSTQLIMPGQEAGLGQVPLIVGILL (PMEL_HUMAN)
  Core: LGQVPLIVG
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSTQLIMPGQEAGXGQXPXIVXILL

SEQ ID NO: 341174 - protein, 14 aa, Artificial Sequence
  Description of Artificial Sequence: Synthetic peptide
  Seed: VSVSQLRALDGGNK (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNK

SEQ ID NO: 341175 - protein, 15 aa, Artificial Sequence
  Description of Artificial Sequence: Synthetic peptide
  Seed: VSVSQLRALDGGNKH (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKH

SEQ ID NO: 341176 - protein, 15 aa, Artificial Sequence
  Description of Artificial Sequence: Synthetic peptide
  Seed: VSVSQLRALDGGNKH (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXH

SEQ ID NO: 341177 - protein, 16 aa, Artificial Sequence
  Description of Artificial Sequence: Synthetic peptide
  Seed: VSVSQLRALDGGNKHF (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHF

SEQ ID NO: 341178 - protein, 17 aa, Artificial Sequence
  Description of Artificial Sequence: Synthetic peptide
  Seed: VSVSQLRALDGGNKHFL (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFL

SEQ ID NO: 341179 - protein, 17 aa, Artificial Sequence
  Description of Artificial Sequence: Synthetic peptide
  Seed: VSVSQLRALDGGNKHFL (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXHFL

SEQ ID NO: 341180 - protein, 19 aa, Artificial Sequence
  Description of Artificial Sequence: Synthetic peptide
  Seed: VSVSQLRALDGGNKHFLRN (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRN

SEQ ID NO: 341181 - protein, 20 aa, Artificial Sequence
  Description of Artificial Sequence: Synthetic peptide
  Seed: VSVSQLRALDGGNKHFLRNQ (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQ

SEQ ID NO: 341182 - protein, 20 aa, Artificial Sequence
  Description of Artificial Sequence: Synthetic peptide
  Seed: VSVSQLRALDGGNKHFLRNQ (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXHFLRNQ

SEQ ID NO: 341183 - protein, 21 aa, Artificial Sequence
  Description of Artificial Sequence: Synthetic peptide
  Seed: VSVSQLRALDGGNKHFLRNQP (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQP

SEQ ID NO: 341184 - protein, 22 aa, Artificial Sequence
  Description of Artificial Sequence: Synthetic peptide
  Seed: VSVSQLRALDGGNKHFLRNQPL (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQPL

SEQ ID NO: 341185 - protein, 22 aa, Artificial Sequence
  Description of Artificial Sequence: Synthetic peptide
  Seed: VSVSQLRALDGGNKHFLRNQPL (PMEL_HUMAN)
  Core: LDGGNKHFL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRAXDGXNXHFXRNQPL

SEQ ID NO: 341186 - protein, 23 aa, Artificial Sequence
  Description of Artificial Sequence: Synthetic peptide
  Seed: VSVSQLRALDGGNKHFLRNQPLT (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQPLT

SEQ ID NO: 341187 - protein, 23 aa, Artificial Sequence
  Description of Artificial Sequence: Synthetic peptide
  Seed: VSVSQLRALDGGNKHFLRNQPLT (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXHFLRNQPLT

SEQ ID NO: 341188 - protein, 23 aa, Artificial Sequence
  Description of Artificial Sequence: Synthetic peptide
  Seed: VSVSQLRALDGGNKHFLRNQPLT (PMEL_HUMAN)
  Core: LDGGNKHFL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRAXDGXNXHFXRNQPLT

SEQ ID NO: 341189 - protein, 24 aa, Artificial Sequence
  Description of Artificial Sequence: Synthetic peptide
  Seed: VSVSQLRALDGGNKHFLRNQPLTF (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQPLTF

SEQ ID NO: 341190 - protein, 24 aa, Artificial Sequence
  Description of Artificial Sequence: Synthetic peptide
  Seed: VSVSQLRALDGGNKHFLRNQPLTF (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXHFLRNQPLTF

SEQ ID NO: 341191 - protein, 24 aa, Artificial Sequence
  Description of Artificial Sequence: Synthetic peptide
  Seed: VSVSQLRALDGGNKHFLRNQPLTF (PMEL_HUMAN)
  Core: RALDGGNKH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLXALXGXNKXFLRNQPLTF

SEQ ID NO: 341192 - protein, 24 aa, Artificial Sequence
  Description of Artificial Sequence: Synthetic peptide
  Seed: VSVSQLRALDGGNKHFLRNQPLTF (PMEL_HUMAN)
  Core: LDGGNKHFL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRAXDGXNXHFXRNQPLTF

SEQ ID NO: 341193 - protein, 24 aa, Artificial Sequence
  Description of Artificial Sequence: Synthetic peptide
  Seed: VSVSQLRALDGGNKHFLRNQPLTF (PMEL_HUMAN)
  Core: KHFLRNQPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRALDGGNXHFXRXQPXTF

SEQ ID NO: 341194 - protein, 24 aa, Artificial Sequence
  Description of Artificial Sequence: Synthetic peptide
  Seed: VSVSQLRALDGGNKHFLRNQPLTF (PMEL_HUMAN)
  Core: FLRNQPLTF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRALDGGNKHXLRXQXLTX

SEQ ID NO: 341195 - protein, 25 aa, Artificial Sequence
  Description of Artificial Sequence: Synthetic peptide
  Seed: VSVSQLRALDGGNKHFLRNQPLTFA (PMEL_HUMAN)
  Core: VSQLRALDG
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VSXSQXRXLDXGNKHFLRNQPLTFA

SEQ ID NO: 341196 - protein, 25 aa, Artificial Sequence
  Description of Artificial Sequence: Synthetic peptide
  Seed: VSVSQLRALDGGNKHFLRNQPLTFA (PMEL_HUMAN)
  Core: LRALDGGNK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQXRAXDXGNXHFLRNQPLTFA

SEQ ID NO: 341197 - protein, 25 aa, Artificial Sequence
  Description of Artificial Sequence: Synthetic peptide
  Seed: VSVSQLRALDGGNKHFLRNQPLTFA (PMEL_HUMAN)
  Core: LDGGNKHFL
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRAXDGXNXHFXRNQPLTFA

SEQ ID NO: 341198 - protein, 25 aa, Artificial Sequence
  Description of Artificial Sequence: Synthetic peptide
  Seed: VSVSQLRALDGGNKHFLRNQPLTFA (PMEL_HUMAN)
  Core: GGNKHFLRN
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRALDXGNXHXLRXQPLTFA

SEQ ID NO: 341199 - protein, 25 aa, Artificial Sequence
  Description of Artificial Sequence: Synthetic peptide
  Seed: VSVSQLRALDGGNKHFLRNQPLTFA (PMEL_HUMAN)
  Core: KHFLRNQPL
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRALDGGNXHFXRXQPXTFA

SEQ ID NO: 341200 - protein, 25 aa, Artificial Sequence
  Description of Artificial Sequence: Synthetic peptide
  Seed: VSVSQLRALDGGNKHFLRNQPLTFA (PMEL_HUMAN)
  Core: FLRNQPLTF
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VSVSQLRALDGGNKHXLRXQXLTXA

SEQ ID NO: 341201 - protein, 13 aa, Artificial Sequence
  Description of Artificial Sequence: Synthetic peptide
  Seed: VTAQVVLQAAIPL (PMEL_HUMAN)
  Core: TAQVVLQAA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXAQXVXQAXIPL

SEQ ID NO: 341202 - protein, 13 aa, Artificial Sequence
  Description of Artificial Sequence: Synthetic peptide
  Seed: VTAQVVLQAAIPL (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPX

SEQ ID NO: 341203 - protein, 14 aa, Artificial Sequence
  Description of Artificial Sequence: Synthetic peptide
  Seed: VTAQVVLQAAIPLT (PMEL_HUMAN)
  Core: TAQVVLQAA
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXAQXVXQAXIPLT

SEQ ID NO: 341204 - protein, 14 aa, Artificial Sequence
  Description of Artificial Sequence: Synthetic peptide
  Seed: VTAQVVLQAAIPLT (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXT

SEQ ID NO: 341205 - protein, 14 aa, Artificial Sequence
  Description of Artificial Sequence: Synthetic peptide
  Seed: VTAQVVLQAAIPLT (PMEL_HUMAN)
  Core: VLQAAIPLT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVXLQXAXPLX

SEQ ID NO: 341206 - protein, 15 aa, Artificial Sequence
  Description of Artificial Sequence: Synthetic peptide
  Seed: VTAQVVLQAAIPLTS (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTS

SEQ ID NO: 341207 - protein, 15 aa, Artificial Sequence
  Description of Artificial Sequence: Synthetic peptide
  Seed: VTAQVVLQAAIPLTS (PMEL_HUMAN)
  Core: VLQAAIPLT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVXLQXAXPLXS

SEQ ID NO: 341208 - protein, 15 aa, Artificial Sequence
  Description of Artificial Sequence: Synthetic peptide
  Seed: VTAQVVLQAAIPLTS (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTX

SEQ ID NO: 341209 - protein, 16 aa, Artificial Sequence
  Description of Artificial Sequence: Synthetic peptide
  Seed: VTAQVVLQAAIPLTSC (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSC

SEQ ID NO: 341210 - protein, 16 aa, Artificial Sequence
  Description of Artificial Sequence: Synthetic peptide
  Seed: VTAQVVLQAAIPLTSC (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXC

SEQ ID NO: 341211 - protein, 17 aa, Artificial Sequence
  Description of Artificial Sequence: Synthetic peptide
  Seed: VTAQVVLQAAIPLTSCG (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCG

SEQ ID NO: 341212 - protein, 17 aa, Artificial Sequence
  Description of Artificial Sequence: Synthetic peptide
  Seed: VTAQVVLQAAIPLTSCG (PMEL_HUMAN)
  Core: VLQAAIPLT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVXLQXAXPLXSCG

SEQ ID NO: 341213 - protein, 17 aa, Artificial Sequence
  Description of Artificial Sequence: Synthetic peptide
  Seed: VTAQVVLQAAIPLTSCG (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCG

SEQ ID NO: 341214 - protein, 18 aa, Artificial Sequence
  Description of Artificial Sequence: Synthetic peptide
  Seed: VTAQVVLQAAIPLTSCGS (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGS

SEQ ID NO: 341215 - protein, 18 aa, Artificial Sequence
  Description of Artificial Sequence: Synthetic peptide
  Seed: VTAQVVLQAAIPLTSCGS (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGS

SEQ ID NO: 341216 - protein, 19 aa, Artificial Sequence
  Description of Artificial Sequence: Synthetic peptide
  Seed: VTAQVVLQAAIPLTSCGSS (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSS

SEQ ID NO: 341217 - protein, 19 aa, Artificial Sequence
  Description of Artificial Sequence: Synthetic peptide
  Seed: VTAQVVLQAAIPLTSCGSS (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSS

SEQ ID NO: 341218 - protein, 20 aa, Artificial Sequence
  Description of Artificial Sequence: Synthetic peptide
  Seed: VTAQVVLQAAIPLTSCGSSP (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSP

SEQ ID NO: 341219 - protein, 20 aa, Artificial Sequence
  Description of Artificial Sequence: Synthetic peptide
  Seed: VTAQVVLQAAIPLTSCGSSP (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSP

SEQ ID NO: 341220 - protein, 21 aa, Artificial Sequence
  Description of Artificial Sequence: Synthetic peptide
  Seed: VTAQVVLQAAIPLTSCGSSPV (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSPV

SEQ ID NO: 341221 - protein, 21 aa, Artificial Sequence
  Description of Artificial Sequence: Synthetic peptide
  Seed: VTAQVVLQAAIPLTSCGSSPV (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSPV

SEQ ID NO: 341222 - protein, 22 aa, Artificial Sequence
  Description of Artificial Sequence: Synthetic peptide
  Seed: VTAQVVLQAAIPLTSCGSSPVP (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSPVP

SEQ ID NO: 341223 - protein, 22 aa, Artificial Sequence
  Description of Artificial Sequence: Synthetic peptide
  Seed: VTAQVVLQAAIPLTSCGSSPVP (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSPVP

SEQ ID NO: 341224 - protein, 23 aa, Artificial Sequence
  Description of Artificial Sequence: Synthetic peptide
  Seed: VTAQVVLQAAIPLTSCGSSPVPG (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSPVPG

SEQ ID NO: 341225 - protein, 23 aa, Artificial Sequence
  Description of Artificial Sequence: Synthetic peptide
  Seed: VTAQVVLQAAIPLTSCGSSPVPG (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSPVPG

SEQ ID NO: 341226 - protein, 23 aa, Artificial Sequence
  Description of Artificial Sequence: Synthetic peptide
  Seed: VTAQVVLQAAIPLTSCGSSPVPG (PMEL_HUMAN)
  Core: LTSCGSSPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVLQAAIPXTSXGXSPXPG

SEQ ID NO: 341227 - protein, 24 aa, Artificial Sequence
  Description of Artificial Sequence: Synthetic peptide
  Seed: VTAQVVLQAAIPLTSCGSSPVPGT (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSPVPGT

SEQ ID NO: 341228 - protein, 24 aa, Artificial Sequence
  Description of Artificial Sequence: Synthetic peptide
  Seed: VTAQVVLQAAIPLTSCGSSPVPGT (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSPVPGT

SEQ ID NO: 341229 - protein, 24 aa, Artificial Sequence
  Description of Artificial Sequence: Synthetic peptide
  Seed: VTAQVVLQAAIPLTSCGSSPVPGT (PMEL_HUMAN)
  Core: LTSCGSSPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVLQAAIPXTSXGXSPXPGT

SEQ ID NO: 341230 - protein, 25 aa, Artificial Sequence
  Description of Artificial Sequence: Synthetic peptide
  Seed: VTAQVVLQAAIPLTSCGSSPVPGTT (PMEL_HUMAN)
  Core: VVLQAAIPL
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTAQXVLXAXIPXTSCGSSPVPGTT

SEQ ID NO: 341231 - protein, 25 aa, Artificial Sequence
  Description of Artificial Sequence: Synthetic peptide
  Seed: VTAQVVLQAAIPLTSCGSSPVPGTT (PMEL_HUMAN)
  Core: LQAAIPLTS
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVXQAXIXLTXCGSSPVPGTT

SEQ ID NO: 341232 - protein, 25 aa, Artificial Sequence
  Description of Artificial Sequence: Synthetic peptide
  Seed: VTAQVVLQAAIPLTSCGSSPVPGTT (PMEL_HUMAN)
  Core: LTSCGSSPV
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VTAQVVLQAAIPXTSXGXSPXPGTT

SEQ ID NO: 341233 - protein, 15 aa, Artificial Sequence
  Description of Artificial Sequence: Synthetic peptide
  Seed: VTHTYLEPGPVTAQV (PMEL_HUMAN)
  Core: HTYLEPGPV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VTXTYXEXGPXTAQV

SEQ ID NO: 341234 - protein, 15 aa, Artificial Sequence
  Description of Artificial Sequence: Synthetic peptide
  Seed: VTHTYLEPGPVTAQV (PMEL_HUMAN)
  Core: LEPGPVTAQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYXEPXPXTAXV

SEQ ID NO: 341235 - protein, 16 aa, Artificial Sequence
  Description of Artificial Sequence: Synthetic peptide
  Seed: VTHTYLEPGPVTAQVV (PMEL_HUMAN)
  Core: LEPGPVTAQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYXEPXPXTAXVV

SEQ ID NO: 341236 - protein, 16 aa, Artificial Sequence
  Description of Artificial Sequence: Synthetic peptide
  Seed: VTHTYLEPGPVTAQVV (PMEL_HUMAN)
  Core: PGPVTAQVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEXGPXTXQVX

SEQ ID NO: 341237 - protein, 17 aa, Artificial Sequence
  Description of Artificial Sequence: Synthetic peptide
  Seed: VTHTYLEPGPVTAQVVL (PMEL_HUMAN)
  Core: LEPGPVTAQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYXEPXPXTAXVVL

SEQ ID NO: 341238 - protein, 17 aa, Artificial Sequence
  Description of Artificial Sequence: Synthetic peptide
  Seed: VTHTYLEPGPVTAQVVL (PMEL_HUMAN)
  Core: PGPVTAQVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEXGPXTXQVXL

SEQ ID NO: 341239 - protein, 18 aa, Artificial Sequence
  Description of Artificial Sequence: Synthetic peptide
  Seed: VTHTYLEPGPVTAQVVLQ (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLX

SEQ ID NO: 341240 - protein, 19 aa, Artificial Sequence
  Description of Artificial Sequence: Synthetic peptide
  Seed: VTHTYLEPGPVTAQVVLQA (PMEL_HUMAN)
  Core: YLEPGPVTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTHTXLEXGXVTXQVVLQA

SEQ ID NO: 341241 - protein, 19 aa, Artificial Sequence
  Description of Artificial Sequence: Synthetic peptide
  Seed: VTHTYLEPGPVTAQVVLQA (PMEL_HUMAN)
  Core: LEPGPVTAQ
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYXEPXPXTAXVVLQA

SEQ ID NO: 341242 - protein, 19 aa, Artificial Sequence
  Description of Artificial Sequence: Synthetic peptide
  Seed: VTHTYLEPGPVTAQVVLQA (PMEL_HUMAN)
  Core: PGPVTAQVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEXGPXTXQVXLQA

SEQ ID NO: 341243 - protein, 19 aa, Artificial Sequence
  Description of Artificial Sequence: Synthetic peptide
  Seed: VTHTYLEPGPVTAQVVLQA (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXA

SEQ ID NO: 341244 - protein, 19 aa, Artificial Sequence
  Description of Artificial Sequence: Synthetic peptide
  Seed: VTHTYLEPGPVTAQVVLQA (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQX

SEQ ID NO: 341245 - protein, 20 aa, Artificial Sequence
  Description of Artificial Sequence: Synthetic peptide
  Seed: VTHTYLEPGPVTAQVVLQAA (PMEL_HUMAN)
  Core: YLEPGPVTA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VTHTXLEXGXVTXQVVLQAA

SEQ ID NO: 341246 - protein, 20 aa, Artificial Sequence
  Description of Artificial Sequence: Synthetic peptide
  Seed: VTHTYLEPGPVTAQVVLQAA (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAA

SEQ ID NO: 341247 - protein, 20 aa, Artificial Sequence
  Description of Artificial Sequence: Synthetic peptide
  Seed: VTHTYLEPGPVTAQVVLQAA (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXA

SEQ ID NO: 341248 - protein, 21 aa, Artificial Sequence
  Description of Artificial Sequence: Synthetic peptide
  Seed: VTHTYLEPGPVTAQVVLQAAI (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAAI

SEQ ID NO: 341249 - protein, 21 aa, Artificial Sequence
  Description of Artificial Sequence: Synthetic peptide
  Seed: VTHTYLEPGPVTAQVVLQAAI (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXAI

SEQ ID NO: 341250 - protein, 21 aa, Artificial Sequence
  Description of Artificial Sequence: Synthetic peptide
  Seed: VTHTYLEPGPVTAQVVLQAAI (PMEL_HUMAN)
  Core: TAQVVLQAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVXAQXVXQAXI

SEQ ID NO: 341251 - protein, 22 aa, Artificial Sequence
  Description of Artificial Sequence: Synthetic peptide
  Seed: VTHTYLEPGPVTAQVVLQAAIP (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAAIP

SEQ ID NO: 341252 - protein, 22 aa, Artificial Sequence
  Description of Artificial Sequence: Synthetic peptide
  Seed: VTHTYLEPGPVTAQVVLQAAIP (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXAIP

SEQ ID NO: 341253 - protein, 22 aa, Artificial Sequence
  Description of Artificial Sequence: Synthetic peptide
  Seed: VTHTYLEPGPVTAQVVLQAAIP (PMEL_HUMAN)
  Core: TAQVVLQAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVXAQXVXQAXIP

SEQ ID NO: 341254 - protein, 23 aa, Artificial Sequence
  Description of Artificial Sequence: Synthetic peptide
  Seed: VTHTYLEPGPVTAQVVLQAAIPL (PMEL_HUMAN)
  Core: PGPVTAQVV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEXGPXTXQVXLQAAIPL

SEQ ID NO: 341255 - protein, 23 aa, Artificial Sequence
  Description of Artificial Sequence: Synthetic peptide
  Seed: VTHTYLEPGPVTAQVVLQAAIPL (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAAIPL

SEQ ID NO: 341256 - protein, 23 aa, Artificial Sequence
  Description of Artificial Sequence: Synthetic peptide
  Seed: VTHTYLEPGPVTAQVVLQAAIPL (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXAIPL

SEQ ID NO: 341257 - protein, 23 aa, Artificial Sequence
  Description of Artificial Sequence: Synthetic peptide
  Seed: VTHTYLEPGPVTAQVVLQAAIPL (PMEL_HUMAN)
  Core: TAQVVLQAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVXAQXVXQAXIPL

SEQ ID NO: 341258 - protein, 24 aa, Artificial Sequence
  Description of Artificial Sequence: Synthetic peptide
  Seed: VTHTYLEPGPVTAQVVLQAAIPLT (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAAIPLT

SEQ ID NO: 341259 - protein, 24 aa, Artificial Sequence
  Description of Artificial Sequence: Synthetic peptide
  Seed: VTHTYLEPGPVTAQVVLQAAIPLT (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXAIPLT

SEQ ID NO: 341260 - protein, 24 aa, Artificial Sequence
  Description of Artificial Sequence: Synthetic peptide
  Seed: VTHTYLEPGPVTAQVVLQAAIPLT (PMEL_HUMAN)
  Core: TAQVVLQAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVXAQXVXQAXIPLT

SEQ ID NO: 341261 - protein, 24 aa, Artificial Sequence
  Description of Artificial Sequence: Synthetic peptide
  Seed: VTHTYLEPGPVTAQVVLQAAIPLT (PMEL_HUMAN)
  Core: VVLQAAIPL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVTAQXVLXAXIPXT

SEQ ID NO: 341262 - protein, 25 aa, Artificial Sequence
  Description of Artificial Sequence: Synthetic peptide
  Seed: VTHTYLEPGPVTAQVVLQAAIPLTS (PMEL_HUMAN)
  Core: PVTAQVVLQ
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGXVTXQXVLXAAIPLTS

SEQ ID NO: 341263 - protein, 25 aa, Artificial Sequence
  Description of Artificial Sequence: Synthetic peptide
  Seed: VTHTYLEPGPVTAQVVLQAAIPLTS (PMEL_HUMAN)
  Core: VTAQVVLQA
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPXTAXVXLQXAIPLTS

SEQ ID NO: 341264 - protein, 25 aa, Artificial Sequence
  Description of Artificial Sequence: Synthetic peptide
  Seed: VTHTYLEPGPVTAQVVLQAAIPLTS (PMEL_HUMAN)
  Core: TAQVVLQAA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVXAQXVXQAXIPLTS

SEQ ID NO: 341265 - protein, 25 aa, Artificial Sequence
  Description of Artificial Sequence: Synthetic peptide
  Seed: VTHTYLEPGPVTAQVVLQAAIPLTS (PMEL_HUMAN)
  Core: VVLQAAIPL
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VTHTYLEPGPVTAQXVLXAXIPXTS

SEQ ID NO: 341266 - protein, 14 aa, Artificial Sequence
  Description of Artificial Sequence: Synthetic peptide
  Seed: VTLDIVQGIESAEI (PMEL_HUMAN)
  Core: LDIVQGIES
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VTXDIXQXIEXAEI

SEQ ID NO: 341267 - protein, 14 aa, Artificial Sequence
  Description of Artificial Sequence: Synthetic peptide
  Seed: VTLDIVQGIESAEI (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEX

SEQ ID NO: 341268 - protein, 15 aa, Artificial Sequence
  Description of Artificial Sequence: Synthetic peptide
  Seed: VTLDIVQGIESAEIL (PMEL_HUMAN)
  Core: LDIVQGIES
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VTXDIXQXIEXAEIL

SEQ ID NO: 341269 - protein, 15 aa, Artificial Sequence
  Description of Artificial Sequence: Synthetic peptide
  Seed: VTLDIVQGIESAEIL (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXL

SEQ ID NO: 341270 - protein, 16 aa, Artificial Sequence
  Description of Artificial Sequence: Synthetic peptide
  Seed: VTLDIVQGIESAEILQ (PMEL_HUMAN)
  Core: LDIVQGIES
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VTXDIXQXIEXAEILQ

SEQ ID NO: 341271 - protein, 16 aa, Artificial Sequence
  Description of Artificial Sequence: Synthetic peptide
  Seed: VTLDIVQGIESAEILQ (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQ

SEQ ID NO: 341272 - protein, 17 aa, Artificial Sequence
  Description of Artificial Sequence: Synthetic peptide
  Seed: VTLDIVQGIESAEILQA (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQA

SEQ ID NO: 341273 - protein, 17 aa, Artificial Sequence
  Description of Artificial Sequence: Synthetic peptide
  Seed: VTLDIVQGIESAEILQA (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQX

SEQ ID NO: 341274 - protein, 18 aa, Artificial Sequence
  Description of Artificial Sequence: Synthetic peptide
  Seed: VTLDIVQGIESAEILQAV (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQAV

SEQ ID NO: 341275 - protein, 18 aa, Artificial Sequence
  Description of Artificial Sequence: Synthetic peptide
  Seed: VTLDIVQGIESAEILQAV (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXV

SEQ ID NO: 341276 - protein, 19 aa, Artificial Sequence
  Description of Artificial Sequence: Synthetic peptide
  Seed: VTLDIVQGIESAEILQAVP (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQAVP

SEQ ID NO: 341277 - protein, 19 aa, Artificial Sequence
  Description of Artificial Sequence: Synthetic peptide
  Seed: VTLDIVQGIESAEILQAVP (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVP

SEQ ID NO: 341278 - protein, 20 aa, Artificial Sequence
  Description of Artificial Sequence: Synthetic peptide
  Seed: VTLDIVQGIESAEILQAVPS (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQAVPS

SEQ ID NO: 341279 - protein, 20 aa, Artificial Sequence
  Description of Artificial Sequence: Synthetic peptide
  Seed: VTLDIVQGIESAEILQAVPS (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPS

SEQ ID NO: 341280 - protein, 21 aa, Artificial Sequence
  Description of Artificial Sequence: Synthetic peptide
  Seed: VTLDIVQGIESAEILQAVPSG (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPSG

SEQ ID NO: 341281 - protein, 21 aa, Artificial Sequence
  Description of Artificial Sequence: Synthetic peptide
  Seed: VTLDIVQGIESAEILQAVPSG (PMEL_HUMAN)
  Core: ESAEILQAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIXSAXIXQAXPSG

SEQ ID NO: 341282 - protein, 22 aa, Artificial Sequence
  Description of Artificial Sequence: Synthetic peptide
  Seed: VTLDIVQGIESAEILQAVPSGE (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPSGE

SEQ ID NO: 341283 - protein, 22 aa, Artificial Sequence
  Description of Artificial Sequence: Synthetic peptide
  Seed: VTLDIVQGIESAEILQAVPSGE (PMEL_HUMAN)
  Core: ESAEILQAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIXSAXIXQAXPSGE

SEQ ID NO: 341284 - protein, 22 aa, Artificial Sequence
  Description of Artificial Sequence: Synthetic peptide
  Seed: VTLDIVQGIESAEILQAVPSGE (PMEL_HUMAN)
  Core: AEILQAVPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESXEIXQXVPXGE

SEQ ID NO: 341285 - protein, 23 aa, Artificial Sequence
  Description of Artificial Sequence: Synthetic peptide
  Seed: VTLDIVQGIESAEILQAVPSGEG (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPSGEG

SEQ ID NO: 341286 - protein, 23 aa, Artificial Sequence
  Description of Artificial Sequence: Synthetic peptide
  Seed: VTLDIVQGIESAEILQAVPSGEG (PMEL_HUMAN)
  Core: ESAEILQAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIXSAXIXQAXPSGEG

SEQ ID NO: 341287 - protein, 23 aa, Artificial Sequence
  Description of Artificial Sequence: Synthetic peptide
  Seed: VTLDIVQGIESAEILQAVPSGEG (PMEL_HUMAN)
  Core: AEILQAVPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESXEIXQXVPXGEG

SEQ ID NO: 341288 - protein, 24 aa, Artificial Sequence
  Description of Artificial Sequence: Synthetic peptide
  Seed: VTLDIVQGIESAEILQAVPSGEGD (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPSGEGD

SEQ ID NO: 341289 - protein, 24 aa, Artificial Sequence
  Description of Artificial Sequence: Synthetic peptide
  Seed: VTLDIVQGIESAEILQAVPSGEGD (PMEL_HUMAN)
  Core: ESAEILQAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIXSAXIXQAXPSGEGD

SEQ ID NO: 341290 - protein, 24 aa, Artificial Sequence
  Description of Artificial Sequence: Synthetic peptide
  Seed: VTLDIVQGIESAEILQAVPSGEGD (PMEL_HUMAN)
  Core: AEILQAVPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESXEIXQXVPXGEGD

SEQ ID NO: 341291 - protein, 25 aa, Artificial Sequence
  Description of Artificial Sequence: Synthetic peptide
  Seed: VTLDIVQGIESAEILQAVPSGEGDA (PMEL_HUMAN)
  Core: VQGIESAEI
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIXQGXEXAEXLQAVPSGEGDA

SEQ ID NO: 341292 - protein, 25 aa, Artificial Sequence
  Description of Artificial Sequence: Synthetic peptide
  Seed: VTLDIVQGIESAEILQAVPSGEGDA (PMEL_HUMAN)
  Core: IESAEILQA
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGXESXEXLQXVPSGEGDA

SEQ ID NO: 341293 - protein, 25 aa, Artificial Sequence
  Description of Artificial Sequence: Synthetic peptide
  Seed: VTLDIVQGIESAEILQAVPSGEGDA (PMEL_HUMAN)
  Core: ESAEILQAV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIXSAXIXQAXPSGEGDA

SEQ ID NO: 341294 - protein, 25 aa, Artificial Sequence
  Description of Artificial Sequence: Synthetic peptide
  Seed: VTLDIVQGIESAEILQAVPSGEGDA (PMEL_HUMAN)
  Core: AEILQAVPS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESXEIXQXVPXGEGDA

SEQ ID NO: 341295 - protein, 25 aa, Artificial Sequence
  Description of Artificial Sequence: Synthetic peptide
  Seed: VTLDIVQGIESAEILQAVPSGEGDA (PMEL_HUMAN)
  Core: ILQAVPSGE
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESAEXLQXVXSGXGDA

SEQ ID NO: 341296 - protein, 25 aa, Artificial Sequence
  Description of Artificial Sequence: Synthetic peptide
  Seed: VTLDIVQGIESAEILQAVPSGEGDA (PMEL_HUMAN)
  Core: LQAVPSGEG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VTLDIVQGIESAEIXQAXPXGEXDA

SEQ ID NO: 341297 - protein, 14 aa, Artificial Sequence
  Description of Artificial Sequence: Synthetic peptide
  Seed: VTTTEWVETTAREL (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREX

SEQ ID NO: 341298 - protein, 15 aa, Artificial Sequence
  Description of Artificial Sequence: Synthetic peptide
  Seed: VTTTEWVETTARELP (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXP

SEQ ID NO: 341299 - protein, 16 aa, Artificial Sequence
  Description of Artificial Sequence: Synthetic peptide
  Seed: VTTTEWVETTARELPI (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPI

SEQ ID NO: 341300 - protein, 17 aa, Artificial Sequence
  Description of Artificial Sequence: Synthetic peptide
  Seed: VTTTEWVETTARELPIP (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIP

SEQ ID NO: 341301 - protein, 18 aa, Artificial Sequence
  Description of Artificial Sequence: Synthetic peptide
  Seed: VTTTEWVETTARELPIPE (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPE

SEQ ID NO: 341302 - protein, 19 aa, Artificial Sequence
  Description of Artificial Sequence: Synthetic peptide
  Seed: VTTTEWVETTARELPIPEP (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEP

SEQ ID NO: 341303 - protein, 20 aa, Artificial Sequence
  Description of Artificial Sequence: Synthetic peptide
  Seed: VTTTEWVETTARELPIPEPE (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPE

SEQ ID NO: 341304 - protein, 21 aa, Artificial Sequence
  Description of Artificial Sequence: Synthetic peptide
  Seed: VTTTEWVETTARELPIPEPEG (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPEG

SEQ ID NO: 341305 - protein, 22 aa, Artificial Sequence
  Description of Artificial Sequence: Synthetic peptide
  Seed: VTTTEWVETTARELPIPEPEGP (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPEGP

SEQ ID NO: 341306 - protein, 23 aa, Artificial Sequence
  Description of Artificial Sequence: Synthetic peptide
  Seed: VTTTEWVETTARELPIPEPEGPD (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPEGPD

SEQ ID NO: 341307 - protein, 23 aa, Artificial Sequence
  Description of Artificial Sequence: Synthetic peptide
  Seed: VTTTEWVETTARELPIPEPEGPD (PMEL_HUMAN)
  Core: RELPIPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEWVETTAXELXIXEPXGPD

SEQ ID NO: 341308 - protein, 24 aa, Artificial Sequence
  Description of Artificial Sequence: Synthetic peptide
  Seed: VTTTEWVETTARELPIPEPEGPDA (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPEGPDA

SEQ ID NO: 341309 - protein, 24 aa, Artificial Sequence
  Description of Artificial Sequence: Synthetic peptide
  Seed: VTTTEWVETTARELPIPEPEGPDA (PMEL_HUMAN)
  Core: RELPIPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEWVETTAXELXIXEPXGPDA

SEQ ID NO: 341310 - protein, 25 aa, Artificial Sequence
  Description of Artificial Sequence: Synthetic peptide
  Seed: VTTTEWVETTARELPIPEPEGPDAS (PMEL_HUMAN)
  Core: WVETTAREL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEXVEXTXREXPIPEPEGPDAS

SEQ ID NO: 341311 - protein, 25 aa, Artificial Sequence
  Description of Artificial Sequence: Synthetic peptide
  Seed: VTTTEWVETTARELPIPEPEGPDAS (PMEL_HUMAN)
  Core: RELPIPEPE
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTTTEWVETTAXELXIXEPXGPDAS

SEQ ID NO: 341312 - protein, 13 aa, Artificial Sequence
  Description of Artificial Sequence: Synthetic peptide
  Seed: VTVYHRRGSRSYV (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXV

SEQ ID NO: 341313 - protein, 14 aa, Artificial Sequence
  Description of Artificial Sequence: Synthetic peptide
  Seed: VTVYHRRGSRSYVP (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVP

SEQ ID NO: 341314 - protein, 15 aa, Artificial Sequence
  Description of Artificial Sequence: Synthetic peptide
  Seed: VTVYHRRGSRSYVPL (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPL

SEQ ID NO: 341315 - protein, 16 aa, Artificial Sequence
  Description of Artificial Sequence: Synthetic peptide
  Seed: VTVYHRRGSRSYVPLA (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLA

SEQ ID NO: 341316 - protein, 16 aa, Artificial Sequence
  Description of Artificial Sequence: Synthetic peptide
  Seed: VTVYHRRGSRSYVPLA (PMEL_HUMAN)
  Core: RRGSRSYVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHXRGXRXYVXLA

SEQ ID NO: 341317 - protein, 17 aa, Artificial Sequence
  Description of Artificial Sequence: Synthetic peptide
  Seed: VTVYHRRGSRSYVPLAH (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAH

SEQ ID NO: 341318 - protein, 17 aa, Artificial Sequence
  Description of Artificial Sequence: Synthetic peptide
  Seed: VTVYHRRGSRSYVPLAH (PMEL_HUMAN)
  Core: RRGSRSYVP
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHXRGXRXYVXLAH

SEQ ID NO: 341319 - protein, 17 aa, Artificial Sequence
  Description of Artificial Sequence: Synthetic peptide
  Seed: VTVYHRRGSRSYVPLAH (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXH

SEQ ID NO: 341320 - protein, 18 aa, Artificial Sequence
  Description of Artificial Sequence: Synthetic peptide
  Seed: VTVYHRRGSRSYVPLAHS (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHS

SEQ ID NO: 341321 - protein, 18 aa, Artificial Sequence
  Description of Artificial Sequence: Synthetic peptide
  Seed: VTVYHRRGSRSYVPLAHS (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXS

SEQ ID NO: 341322 - protein, 18 aa, Artificial Sequence
  Description of Artificial Sequence: Synthetic peptide
  Seed: VTVYHRRGSRSYVPLAHS (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHX

SEQ ID NO: 341323 - protein, 19 aa, Artificial Sequence
  Description of Artificial Sequence: Synthetic peptide
  Seed: VTVYHRRGSRSYVPLAHSS (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHSS

SEQ ID NO: 341324 - protein, 19 aa, Artificial Sequence
  Description of Artificial Sequence: Synthetic peptide
  Seed: VTVYHRRGSRSYVPLAHSS (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSS

SEQ ID NO: 341325 - protein, 19 aa, Artificial Sequence
  Description of Artificial Sequence: Synthetic peptide
  Seed: VTVYHRRGSRSYVPLAHSS (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSS

SEQ ID NO: 341326 - protein, 19 aa, Artificial Sequence
  Description of Artificial Sequence: Synthetic peptide
  Seed: VTVYHRRGSRSYVPLAHSS (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXS

SEQ ID NO: 341327 - protein, 20 aa, Artificial Sequence
  Description of Artificial Sequence: Synthetic peptide
  Seed: VTVYHRRGSRSYVPLAHSSS (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHSSS

SEQ ID NO: 341328 - protein, 20 aa, Artificial Sequence
  Description of Artificial Sequence: Synthetic peptide
  Seed: VTVYHRRGSRSYVPLAHSSS (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSS

SEQ ID NO: 341329 - protein, 20 aa, Artificial Sequence
  Description of Artificial Sequence: Synthetic peptide
  Seed: VTVYHRRGSRSYVPLAHSSS (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSS

SEQ ID NO: 341330 - protein, 20 aa, Artificial Sequence
  Description of Artificial Sequence: Synthetic peptide
  Seed: VTVYHRRGSRSYVPLAHSSS (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSS

SEQ ID NO: 341331 - protein, 20 aa, Artificial Sequence
  Description of Artificial Sequence: Synthetic peptide
  Seed: VTVYHRRGSRSYVPLAHSSS (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSX

SEQ ID NO: 341332 - protein, 21 aa, Artificial Sequence
  Description of Artificial Sequence: Synthetic peptide
  Seed: VTVYHRRGSRSYVPLAHSSSA (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHSSSA

SEQ ID NO: 341333 - protein, 21 aa, Artificial Sequence
  Description of Artificial Sequence: Synthetic peptide
  Seed: VTVYHRRGSRSYVPLAHSSSA (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSSA

SEQ ID NO: 341334 - protein, 21 aa, Artificial Sequence
  Description of Artificial Sequence: Synthetic peptide
  Seed: VTVYHRRGSRSYVPLAHSSSA (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSSA

SEQ ID NO: 341335 - protein, 21 aa, Artificial Sequence
  Description of Artificial Sequence: Synthetic peptide
  Seed: VTVYHRRGSRSYVPLAHSSSA (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSSA

SEQ ID NO: 341336 - protein, 21 aa, Artificial Sequence
  Description of Artificial Sequence: Synthetic peptide
  Seed: VTVYHRRGSRSYVPLAHSSSA (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSXA

SEQ ID NO: 341337 - protein, 22 aa, Artificial Sequence
  Description of Artificial Sequence: Synthetic peptide
  Seed: VTVYHRRGSRSYVPLAHSSSAF (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHSSSAF

SEQ ID NO: 341338 - protein, 22 aa, Artificial Sequence
  Description of Artificial Sequence: Synthetic peptide
  Seed: VTVYHRRGSRSYVPLAHSSSAF (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSSAF

SEQ ID NO: 341339 - protein, 22 aa, Artificial Sequence
  Description of Artificial Sequence: Synthetic peptide
  Seed: VTVYHRRGSRSYVPLAHSSSAF (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSSAF

SEQ ID NO: 341340 - protein, 22 aa, Artificial Sequence
  Description of Artificial Sequence: Synthetic peptide
  Seed: VTVYHRRGSRSYVPLAHSSSAF (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSSAF

SEQ ID NO: 341341 - protein, 22 aa, Artificial Sequence
  Description of Artificial Sequence: Synthetic peptide
  Seed: VTVYHRRGSRSYVPLAHSSSAF (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSXAF

SEQ ID NO: 341342 - protein, 23 aa, Artificial Sequence
  Description of Artificial Sequence: Synthetic peptide
  Seed: VTVYHRRGSRSYVPLAHSSSAFT (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSSAFT

SEQ ID NO: 341343 - protein, 23 aa, Artificial Sequence
  Description of Artificial Sequence: Synthetic peptide
  Seed: VTVYHRRGSRSYVPLAHSSSAFT (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSSAFT

SEQ ID NO: 341344 - protein, 23 aa, Artificial Sequence
  Description of Artificial Sequence: Synthetic peptide
  Seed: VTVYHRRGSRSYVPLAHSSSAFT (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSSAFT

SEQ ID NO: 341345 - protein, 23 aa, Artificial Sequence
  Description of Artificial Sequence: Synthetic peptide
  Seed: VTVYHRRGSRSYVPLAHSSSAFT (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSXAFT

SEQ ID NO: 341346 - protein, 24 aa, Artificial Sequence
  Description of Artificial Sequence: Synthetic peptide
  Seed: VTVYHRRGSRSYVPLAHSSSAFTI (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSSAFTI

SEQ ID NO: 341347 - protein, 24 aa, Artificial Sequence
  Description of Artificial Sequence: Synthetic peptide
  Seed: VTVYHRRGSRSYVPLAHSSSAFTI (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSSAFTI

SEQ ID NO: 341348 - protein, 24 aa, Artificial Sequence
  Description of Artificial Sequence: Synthetic peptide
  Seed: VTVYHRRGSRSYVPLAHSSSAFTI (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSSAFTI

SEQ ID NO: 341349 - protein, 24 aa, Artificial Sequence
  Description of Artificial Sequence: Synthetic peptide
  Seed: VTVYHRRGSRSYVPLAHSSSAFTI (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSXAFTI

SEQ ID NO: 341350 - protein, 24 aa, Artificial Sequence
  Description of Artificial Sequence: Synthetic peptide
  Seed: VTVYHRRGSRSYVPLAHSSSAFTI (PMEL_HUMAN)
  Core: LAHSSSAFT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSYVPXAHXSXAFXI

SEQ ID NO: 341351 - protein, 25 aa, Artificial Sequence
  Description of Artificial Sequence: Synthetic peptide
  Seed: VTVYHRRGSRSYVPLAHSSSAFTIT (PMEL_HUMAN)
  Core: YHRRGSRSY
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VTVXHRXGXRSXVPLAHSSSAFTIT

SEQ ID NO: 341352 - protein, 25 aa, Artificial Sequence
  Description of Artificial Sequence: Synthetic peptide
  Seed: VTVYHRRGSRSYVPLAHSSSAFTIT (PMEL_HUMAN)
  Core: GSRSYVPLA
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRXSRXYXPLXHSSSAFTIT

SEQ ID NO: 341353 - protein, 25 aa, Artificial Sequence
  Description of Artificial Sequence: Synthetic peptide
  Seed: VTVYHRRGSRSYVPLAHSSSAFTIT (PMEL_HUMAN)
  Core: SRSYVPLAH
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGXRSXVXLAXSSSAFTIT

SEQ ID NO: 341354 - protein, 25 aa, Artificial Sequence
  Description of Artificial Sequence: Synthetic peptide
  Seed: VTVYHRRGSRSYVPLAHSSSAFTIT (PMEL_HUMAN)
  Core: RSYVPLAHS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSXSYXPXAHXSSAFTIT

SEQ ID NO: 341355 - protein, 25 aa, Artificial Sequence
  Description of Artificial Sequence: Synthetic peptide
  Seed: VTVYHRRGSRSYVPLAHSSSAFTIT (PMEL_HUMAN)
  Core: YVPLAHSSS
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSXVPXAXSSXAFTIT

SEQ ID NO: 341356 - protein, 25 aa, Artificial Sequence
  Description of Artificial Sequence: Synthetic peptide
  Seed: VTVYHRRGSRSYVPLAHSSSAFTIT (PMEL_HUMAN)
  Core: LAHSSSAFT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSYVPXAHXSXAFXIT

SEQ ID NO: 341357 - protein, 25 aa, Artificial Sequence
  Description of Artificial Sequence: Synthetic peptide
  Seed: VTVYHRRGSRSYVPLAHSSSAFTIT (PMEL_HUMAN)
  Core: AHSSSAFTI
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VTVYHRRGSRSYVPLXHSXSXFTXT

SEQ ID NO: 341358 - protein, 13 aa, Artificial Sequence
  Description of Artificial Sequence: Synthetic peptide
  Seed: VVGTTPGQAPTAE (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXE

SEQ ID NO: 341359 - protein, 14 aa, Artificial Sequence
  Description of Artificial Sequence: Synthetic peptide
  Seed: VVGTTPGQAPTAEP (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEP

SEQ ID NO: 341360 - protein, 15 aa, Artificial Sequence
  Description of Artificial Sequence: Synthetic peptide
  Seed: VVGTTPGQAPTAEPS (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPS

SEQ ID NO: 341361 - protein, 16 aa, Artificial Sequence
  Description of Artificial Sequence: Synthetic peptide
  Seed: VVGTTPGQAPTAEPSG (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSG

SEQ ID NO: 341362 - protein, 17 aa, Artificial Sequence
  Description of Artificial Sequence: Synthetic peptide
  Seed: VVGTTPGQAPTAEPSGT (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGT

SEQ ID NO: 341363 - protein, 19 aa, Artificial Sequence
  Description of Artificial Sequence: Synthetic peptide
  Seed: VVGTTPGQAPTAEPSGTTS (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTS

SEQ ID NO: 341364 - protein, 20 aa, Artificial Sequence
  Description of Artificial Sequence: Synthetic peptide
  Seed: VVGTTPGQAPTAEPSGTTSV (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSV

SEQ ID NO: 341365 - protein, 21 aa, Artificial Sequence
  Description of Artificial Sequence: Synthetic peptide
  Seed: VVGTTPGQAPTAEPSGTTSVQ (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSVQ

SEQ ID NO: 341366 - protein, 22 aa, Artificial Sequence
  Description of Artificial Sequence: Synthetic peptide
  Seed: VVGTTPGQAPTAEPSGTTSVQV (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSVQV

SEQ ID NO: 341367 - protein, 23 aa, Artificial Sequence
  Description of Artificial Sequence: Synthetic peptide
  Seed: VVGTTPGQAPTAEPSGTTSVQVP (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSVQVP

SEQ ID NO: 341368 - protein, 24 aa, Artificial Sequence
  Description of Artificial Sequence: Synthetic peptide
  Seed: VVGTTPGQAPTAEPSGTTSVQVPT (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSVQVPT

SEQ ID NO: 341369 - protein, 25 aa, Artificial Sequence
  Description of Artificial Sequence: Synthetic peptide
  Seed: VVGTTPGQAPTAEPSGTTSVQVPTT (PMEL_HUMAN)
  Core: TTPGQAPTA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVGXTPXQXPTXEPSGTTSVQVPTT

SEQ ID NO: 341370 - protein, 13 aa, Artificial Sequence
  Description of Artificial Sequence: Synthetic peptide
  Seed: VVLASLIYRRRLM (PMEL_HUMAN)
  Core: VLASLIYRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLAXLXYRXRLM

SEQ ID NO: 341371 - protein, 13 aa, Artificial Sequence
  Description of Artificial Sequence: Synthetic peptide
  Seed: VVLASLIYRRRLM (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLM

SEQ ID NO: 341372 - protein, 13 aa, Artificial Sequence
  Description of Artificial Sequence: Synthetic peptide
  Seed: VVLASLIYRRRLM (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXM

SEQ ID NO: 341373 - protein, 14 aa, Artificial Sequence
  Description of Artificial Sequence: Synthetic peptide
  Seed: VVLASLIYRRRLMK (PMEL_HUMAN)
  Core: VLASLIYRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLAXLXYRXRLMK

SEQ ID NO: 341374 - protein, 14 aa, Artificial Sequence
  Description of Artificial Sequence: Synthetic peptide
  Seed: VVLASLIYRRRLMK (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMK

SEQ ID NO: 341375 - protein, 14 aa, Artificial Sequence
  Description of Artificial Sequence: Synthetic peptide
  Seed: VVLASLIYRRRLMK (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMK

SEQ ID NO: 341376 - protein, 14 aa, Artificial Sequence
  Description of Artificial Sequence: Synthetic peptide
  Seed: VVLASLIYRRRLMK (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXK

SEQ ID NO: 341377 - protein, 14 aa, Artificial Sequence
  Description of Artificial Sequence: Synthetic peptide
  Seed: VVLASLIYRRRLMK (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMX

SEQ ID NO: 341378 - protein, 15 aa, Artificial Sequence
  Description of Artificial Sequence: Synthetic peptide
  Seed: VVLASLIYRRRLMKQ (PMEL_HUMAN)
  Core: VLASLIYRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLAXLXYRXRLMKQ

SEQ ID NO: 341379 - protein, 15 aa, Artificial Sequence
  Description of Artificial Sequence: Synthetic peptide
  Seed: VVLASLIYRRRLMKQ (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQ

SEQ ID NO: 341380 - protein, 15 aa, Artificial Sequence
  Description of Artificial Sequence: Synthetic peptide
  Seed: VVLASLIYRRRLMKQ (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMKQ

SEQ ID NO: 341381 - protein, 15 aa, Artificial Sequence
  Description of Artificial Sequence: Synthetic peptide
  Seed: VVLASLIYRRRLMKQ (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQ

SEQ ID NO: 341382 - protein, 15 aa, Artificial Sequence
  Description of Artificial Sequence: Synthetic peptide
  Seed: VVLASLIYRRRLMKQ (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQ

SEQ ID NO: 341383 - protein, 15 aa, Artificial Sequence
  Description of Artificial Sequence: Synthetic peptide
  Seed: VVLASLIYRRRLMKQ (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKX

SEQ ID NO: 341384 - protein, 16 aa, Artificial Sequence
  Description of Artificial Sequence: Synthetic peptide
  Seed: VVLASLIYRRRLMKQD (PMEL_HUMAN)
  Core: VLASLIYRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLAXLXYRXRLMKQD

SEQ ID NO: 341385 - protein, 16 aa, Artificial Sequence
  Description of Artificial Sequence: Synthetic peptide
  Seed: VVLASLIYRRRLMKQD (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQD

SEQ ID NO: 341386 - protein, 16 aa, Artificial Sequence
  Description of Artificial Sequence: Synthetic peptide
  Seed: VVLASLIYRRRLMKQD (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMKQD

SEQ ID NO: 341387 - protein, 16 aa, Artificial Sequence
  Description of Artificial Sequence: Synthetic peptide
  Seed: VVLASLIYRRRLMKQD (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQD

SEQ ID NO: 341388 - protein, 16 aa, Artificial Sequence
  Description of Artificial Sequence: Synthetic peptide
  Seed: VVLASLIYRRRLMKQD (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQD

SEQ ID NO: 341389 - protein, 16 aa, Artificial Sequence
  Description of Artificial Sequence: Synthetic peptide
  Seed: VVLASLIYRRRLMKQD (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXD

SEQ ID NO: 341390 - protein, 16 aa, Artificial Sequence
  Description of Artificial Sequence: Synthetic peptide
  Seed: VVLASLIYRRRLMKQD (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQX

SEQ ID NO: 341391 - protein, 17 aa, Artificial Sequence
  Description of Artificial Sequence: Synthetic peptide
  Seed: VVLASLIYRRRLMKQDF (PMEL_HUMAN)
  Core: VLASLIYRR
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLAXLXYRXRLMKQDF

SEQ ID NO: 341392 - protein, 17 aa, Artificial Sequence
  Description of Artificial Sequence: Synthetic peptide
  Seed: VVLASLIYRRRLMKQDF (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDF

SEQ ID NO: 341393 - protein, 17 aa, Artificial Sequence
  Description of Artificial Sequence: Synthetic peptide
  Seed: VVLASLIYRRRLMKQDF (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMKQDF

SEQ ID NO: 341394 - protein, 17 aa, Artificial Sequence
  Description of Artificial Sequence: Synthetic peptide
  Seed: VVLASLIYRRRLMKQDF (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDF

SEQ ID NO: 341395 - protein, 17 aa, Artificial Sequence
  Description of Artificial Sequence: Synthetic peptide
  Seed: VVLASLIYRRRLMKQDF (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDF

SEQ ID NO: 341396 - protein, 17 aa, Artificial Sequence
  Description of Artificial Sequence: Synthetic peptide
  Seed: VVLASLIYRRRLMKQDF (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDF

SEQ ID NO: 341397 - protein, 17 aa, Artificial Sequence
  Description of Artificial Sequence: Synthetic peptide
  Seed: VVLASLIYRRRLMKQDF (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXF

SEQ ID NO: 341398 - protein, 18 aa, Artificial Sequence
  Description of Artificial Sequence: Synthetic peptide
  Seed: VVLASLIYRRRLMKQDFS (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFS

SEQ ID NO: 341399 - protein, 18 aa, Artificial Sequence
  Description of Artificial Sequence: Synthetic peptide
  Seed: VVLASLIYRRRLMKQDFS (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFS

SEQ ID NO: 341400 - protein, 18 aa, Artificial Sequence
  Description of Artificial Sequence: Synthetic peptide
  Seed: VVLASLIYRRRLMKQDFS (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFS

SEQ ID NO: 341401 - protein, 18 aa, Artificial Sequence
  Description of Artificial Sequence: Synthetic peptide
  Seed: VVLASLIYRRRLMKQDFS (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFS

SEQ ID NO: 341402 - protein, 19 aa, Artificial Sequence
  Description of Artificial Sequence: Synthetic peptide
  Seed: VVLASLIYRRRLMKQDFSV (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSV

SEQ ID NO: 341403 - protein, 19 aa, Artificial Sequence
  Description of Artificial Sequence: Synthetic peptide
  Seed: VVLASLIYRRRLMKQDFSV (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMKQDFSV

SEQ ID NO: 341404 - protein, 19 aa, Artificial Sequence
  Description of Artificial Sequence: Synthetic peptide
  Seed: VVLASLIYRRRLMKQDFSV (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSV

SEQ ID NO: 341405 - protein, 19 aa, Artificial Sequence
  Description of Artificial Sequence: Synthetic peptide
  Seed: VVLASLIYRRRLMKQDFSV (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSV

SEQ ID NO: 341406 - protein, 19 aa, Artificial Sequence
  Description of Artificial Sequence: Synthetic peptide
  Seed: VVLASLIYRRRLMKQDFSV (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSV

SEQ ID NO: 341407 - protein, 19 aa, Artificial Sequence
  Description of Artificial Sequence: Synthetic peptide
  Seed: VVLASLIYRRRLMKQDFSV (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSV

SEQ ID NO: 341408 - protein, 20 aa, Artificial Sequence
  Description of Artificial Sequence: Synthetic peptide
  Seed: VVLASLIYRRRLMKQDFSVP (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVP

SEQ ID NO: 341409 - protein, 20 aa, Artificial Sequence
  Description of Artificial Sequence: Synthetic peptide
  Seed: VVLASLIYRRRLMKQDFSVP (PMEL_HUMAN)
  Core: ASLIYRRRL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXSLXYXRRXMKQDFSVP

SEQ ID NO: 341410 - protein, 20 aa, Artificial Sequence
  Description of Artificial Sequence: Synthetic peptide
  Seed: VVLASLIYRRRLMKQDFSVP (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVP

SEQ ID NO: 341411 - protein, 20 aa, Artificial Sequence
  Description of Artificial Sequence: Synthetic peptide
  Seed: VVLASLIYRRRLMKQDFSVP (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVP

SEQ ID NO: 341412 - protein, 20 aa, Artificial Sequence
  Description of Artificial Sequence: Synthetic peptide
  Seed: VVLASLIYRRRLMKQDFSVP (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVP

SEQ ID NO: 341413 - protein, 20 aa, Artificial Sequence
  Description of Artificial Sequence: Synthetic peptide
  Seed: VVLASLIYRRRLMKQDFSVP (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVP

SEQ ID NO: 341414 - protein, 20 aa, Artificial Sequence
  Description of Artificial Sequence: Synthetic peptide
  Seed: VVLASLIYRRRLMKQDFSVP (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVP

SEQ ID NO: 341415 - protein, 20 aa, Artificial Sequence
  Description of Artificial Sequence: Synthetic peptide
  Seed: VVLASLIYRRRLMKQDFSVP (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXP

SEQ ID NO: 341416 - protein, 21 aa, Artificial Sequence
  Description of Artificial Sequence: Synthetic peptide
  Seed: VVLASLIYRRRLMKQDFSVPQ (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVPQ

SEQ ID NO: 341417 - protein, 21 aa, Artificial Sequence
  Description of Artificial Sequence: Synthetic peptide
  Seed: VVLASLIYRRRLMKQDFSVPQ (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVPQ

SEQ ID NO: 341418 - protein, 21 aa, Artificial Sequence
  Description of Artificial Sequence: Synthetic peptide
  Seed: VVLASLIYRRRLMKQDFSVPQ (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVPQ

SEQ ID NO: 341419 - protein, 21 aa, Artificial Sequence
  Description of Artificial Sequence: Synthetic peptide
  Seed: VVLASLIYRRRLMKQDFSVPQ (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVPQ

SEQ ID NO: 341420 - protein, 21 aa, Artificial Sequence
  Description of Artificial Sequence: Synthetic peptide
  Seed: VVLASLIYRRRLMKQDFSVPQ (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVPQ

SEQ ID NO: 341421 - protein, 21 aa, Artificial Sequence
  Description of Artificial Sequence: Synthetic peptide
  Seed: VVLASLIYRRRLMKQDFSVPQ (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVPQ

SEQ ID NO: 341422 - protein, 21 aa, Artificial Sequence
  Description of Artificial Sequence: Synthetic peptide
  Seed: VVLASLIYRRRLMKQDFSVPQ (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXPQ

SEQ ID NO: 341423 - protein, 21 aa, Artificial Sequence
  Description of Artificial Sequence: Synthetic peptide
  Seed: VVLASLIYRRRLMKQDFSVPQ (PMEL_HUMAN)
  Core: LMKQDFSVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRXMKXDXSVXQ

SEQ ID NO: 341424 - protein, 21 aa, Artificial Sequence
  Description of Artificial Sequence: Synthetic peptide
  Seed: VVLASLIYRRRLMKQDFSVPQ (PMEL_HUMAN)
  Core: MKQDFSVPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLXKQXFXVPX

SEQ ID NO: 341425 - protein, 22 aa, Artificial Sequence
  Description of Artificial Sequence: Synthetic peptide
  Seed: VVLASLIYRRRLMKQDFSVPQL (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVPQL

SEQ ID NO: 341426 - protein, 22 aa, Artificial Sequence
  Description of Artificial Sequence: Synthetic peptide
  Seed: VVLASLIYRRRLMKQDFSVPQL (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVPQL

SEQ ID NO: 341427 - protein, 22 aa, Artificial Sequence
  Description of Artificial Sequence: Synthetic peptide
  Seed: VVLASLIYRRRLMKQDFSVPQL (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVPQL

SEQ ID NO: 341428 - protein, 22 aa, Artificial Sequence
  Description of Artificial Sequence: Synthetic peptide
  Seed: VVLASLIYRRRLMKQDFSVPQL (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVPQL

SEQ ID NO: 341429 - protein, 22 aa, Artificial Sequence
  Description of Artificial Sequence: Synthetic peptide
  Seed: VVLASLIYRRRLMKQDFSVPQL (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVPQL

SEQ ID NO: 341430 - protein, 22 aa, Artificial Sequence
  Description of Artificial Sequence: Synthetic peptide
  Seed: VVLASLIYRRRLMKQDFSVPQL (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVPQL

SEQ ID NO: 341431 - protein, 22 aa, Artificial Sequence
  Description of Artificial Sequence: Synthetic peptide
  Seed: VVLASLIYRRRLMKQDFSVPQL (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXPQL

SEQ ID NO: 341432 - protein, 22 aa, Artificial Sequence
  Description of Artificial Sequence: Synthetic peptide
  Seed: VVLASLIYRRRLMKQDFSVPQL (PMEL_HUMAN)
  Core: LMKQDFSVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRXMKXDXSVXQL

SEQ ID NO: 341433 - protein, 22 aa, Artificial Sequence
  Description of Artificial Sequence: Synthetic peptide
  Seed: VVLASLIYRRRLMKQDFSVPQL (PMEL_HUMAN)
  Core: MKQDFSVPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLXKQXFXVPXL

SEQ ID NO: 341434 - protein, 23 aa, Artificial Sequence
  Description of Artificial Sequence: Synthetic peptide
  Seed: VVLASLIYRRRLMKQDFSVPQLP (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVPQLP

SEQ ID NO: 341435 - protein, 23 aa, Artificial Sequence
  Description of Artificial Sequence: Synthetic peptide
  Seed: VVLASLIYRRRLMKQDFSVPQLP (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVPQLP

SEQ ID NO: 341436 - protein, 23 aa, Artificial Sequence
  Description of Artificial Sequence: Synthetic peptide
  Seed: VVLASLIYRRRLMKQDFSVPQLP (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVPQLP

SEQ ID NO: 341437 - protein, 23 aa, Artificial Sequence
  Description of Artificial Sequence: Synthetic peptide
  Seed: VVLASLIYRRRLMKQDFSVPQLP (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVPQLP

SEQ ID NO: 341438 - protein, 23 aa, Artificial Sequence
  Description of Artificial Sequence: Synthetic peptide
  Seed: VVLASLIYRRRLMKQDFSVPQLP (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVPQLP

SEQ ID NO: 341439 - protein, 23 aa, Artificial Sequence
  Description of Artificial Sequence: Synthetic peptide
  Seed: VVLASLIYRRRLMKQDFSVPQLP (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVPQLP

SEQ ID NO: 341440 - protein, 23 aa, Artificial Sequence
  Description of Artificial Sequence: Synthetic peptide
  Seed: VVLASLIYRRRLMKQDFSVPQLP (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXPQLP

SEQ ID NO: 341441 - protein, 23 aa, Artificial Sequence
  Description of Artificial Sequence: Synthetic peptide
  Seed: VVLASLIYRRRLMKQDFSVPQLP (PMEL_HUMAN)
  Core: LMKQDFSVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRXMKXDXSVXQLP

SEQ ID NO: 341442 - protein, 23 aa, Artificial Sequence
  Description of Artificial Sequence: Synthetic peptide
  Seed: VVLASLIYRRRLMKQDFSVPQLP (PMEL_HUMAN)
  Core: MKQDFSVPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLXKQXFXVPXLP

SEQ ID NO: 341443 - protein, 24 aa, Artificial Sequence
  Description of Artificial Sequence: Synthetic peptide
  Seed: VVLASLIYRRRLMKQDFSVPQLPH (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVPQLPH

SEQ ID NO: 341444 - protein, 24 aa, Artificial Sequence
  Description of Artificial Sequence: Synthetic peptide
  Seed: VVLASLIYRRRLMKQDFSVPQLPH (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVPQLPH

SEQ ID NO: 341445 - protein, 24 aa, Artificial Sequence
  Description of Artificial Sequence: Synthetic peptide
  Seed: VVLASLIYRRRLMKQDFSVPQLPH (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVPQLPH

SEQ ID NO: 341446 - protein, 24 aa, Artificial Sequence
  Description of Artificial Sequence: Synthetic peptide
  Seed: VVLASLIYRRRLMKQDFSVPQLPH (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVPQLPH

SEQ ID NO: 341447 - protein, 24 aa, Artificial Sequence
  Description of Artificial Sequence: Synthetic peptide
  Seed: VVLASLIYRRRLMKQDFSVPQLPH (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVPQLPH

SEQ ID NO: 341448 - protein, 24 aa, Artificial Sequence
  Description of Artificial Sequence: Synthetic peptide
  Seed: VVLASLIYRRRLMKQDFSVPQLPH (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVPQLPH

SEQ ID NO: 341449 - protein, 24 aa, Artificial Sequence
  Description of Artificial Sequence: Synthetic peptide
  Seed: VVLASLIYRRRLMKQDFSVPQLPH (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXPQLPH

SEQ ID NO: 341450 - protein, 24 aa, Artificial Sequence
  Description of Artificial Sequence: Synthetic peptide
  Seed: VVLASLIYRRRLMKQDFSVPQLPH (PMEL_HUMAN)
  Core: LMKQDFSVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRXMKXDXSVXQLPH

SEQ ID NO: 341451 - protein, 24 aa, Artificial Sequence
  Description of Artificial Sequence: Synthetic peptide
  Seed: VVLASLIYRRRLMKQDFSVPQLPH (PMEL_HUMAN)
  Core: MKQDFSVPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLXKQXFXVPXLPH

SEQ ID NO: 341452 - protein, 25 aa, Artificial Sequence
  Description of Artificial Sequence: Synthetic peptide
  Seed: VVLASLIYRRRLMKQDFSVPQLPHS (PMEL_HUMAN)
  Core: LASLIYRRR
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXASXIXRRXLMKQDFSVPQLPHS

SEQ ID NO: 341453 - protein, 25 aa, Artificial Sequence
  Description of Artificial Sequence: Synthetic peptide
  Seed: VVLASLIYRRRLMKQDFSVPQLPHS (PMEL_HUMAN)
  Core: SLIYRRRLM
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVLAXLIXRXRLXKQDFSVPQLPHS

SEQ ID NO: 341454 - protein, 25 aa, Artificial Sequence
  Description of Artificial Sequence: Synthetic peptide
  Seed: VVLASLIYRRRLMKQDFSVPQLPHS (PMEL_HUMAN)
  Core: LIYRRRLMK
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLASXIYXRXLMXQDFSVPQLPHS

SEQ ID NO: 341455 - protein, 25 aa, Artificial Sequence
  Description of Artificial Sequence: Synthetic peptide
  Seed: VVLASLIYRRRLMKQDFSVPQLPHS (PMEL_HUMAN)
  Core: IYRRRLMKQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLXYRXRXMKXDFSVPQLPHS

SEQ ID NO: 341456 - protein, 25 aa, Artificial Sequence
  Description of Artificial Sequence: Synthetic peptide
  Seed: VVLASLIYRRRLMKQDFSVPQLPHS (PMEL_HUMAN)
  Core: YRRRLMKQD
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIXRRXLXKQXFSVPQLPHS

SEQ ID NO: 341457 - protein, 25 aa, Artificial Sequence
  Description of Artificial Sequence: Synthetic peptide
  Seed: VVLASLIYRRRLMKQDFSVPQLPHS (PMEL_HUMAN)
  Core: RRLMKQDFS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRXRLXKXDFXVPQLPHS

SEQ ID NO: 341458 - protein, 25 aa, Artificial Sequence
  Description of Artificial Sequence: Synthetic peptide
  Seed: VVLASLIYRRRLMKQDFSVPQLPHS (PMEL_HUMAN)
  Core: RLMKQDFSV
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRXLMXQXFSXPQLPHS

SEQ ID NO: 341459 - protein, 25 aa, Artificial Sequence
  Description of Artificial Sequence: Synthetic peptide
  Seed: VVLASLIYRRRLMKQDFSVPQLPHS (PMEL_HUMAN)
  Core: LMKQDFSVP
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRXMKXDXSVXQLPHS

SEQ ID NO: 341460 - protein, 25 aa, Artificial Sequence
  Description of Artificial Sequence: Synthetic peptide
  Seed: VVLASLIYRRRLMKQDFSVPQLPHS (PMEL_HUMAN)
  Core: MKQDFSVPQ
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLXKQXFXVPXLPHS

SEQ ID NO: 341461 - protein, 25 aa, Artificial Sequence
  Description of Artificial Sequence: Synthetic peptide
  Seed: VVLASLIYRRRLMKQDFSVPQLPHS (PMEL_HUMAN)
  Core: QDFSVPQLP
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VVLASLIYRRRLMKXDFXVXQLXHS

SEQ ID NO: 341462 - protein, 13 aa, Artificial Sequence
  Description of Artificial Sequence: Synthetic peptide
  Seed: VVLQAAIPLTSCG (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCG

SEQ ID NO: 341463 - protein, 14 aa, Artificial Sequence
  Description of Artificial Sequence: Synthetic peptide
  Seed: VVLQAAIPLTSCGS (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGS

SEQ ID NO: 341464 - protein, 15 aa, Artificial Sequence
  Description of Artificial Sequence: Synthetic peptide
  Seed: VVLQAAIPLTSCGSS (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSS

SEQ ID NO: 341465 - protein, 16 aa, Artificial Sequence
  Description of Artificial Sequence: Synthetic peptide
  Seed: VVLQAAIPLTSCGSSP (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSP

SEQ ID NO: 341466 - protein, 17 aa, Artificial Sequence
  Description of Artificial Sequence: Synthetic peptide
  Seed: VVLQAAIPLTSCGSSPV (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPV

SEQ ID NO: 341467 - protein, 17 aa, Artificial Sequence
  Description of Artificial Sequence: Synthetic peptide
  Seed: VVLQAAIPLTSCGSSPV (PMEL_HUMAN)
  Core: AIPLTSCGS
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAXIPXTXCGXSPV

SEQ ID NO: 341468 - protein, 18 aa, Artificial Sequence
  Description of Artificial Sequence: Synthetic peptide
  Seed: VVLQAAIPLTSCGSSPVP (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVP

SEQ ID NO: 341469 - protein, 19 aa, Artificial Sequence
  Description of Artificial Sequence: Synthetic peptide
  Seed: VVLQAAIPLTSCGSSPVPG (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPG

SEQ ID NO: 341470 - protein, 19 aa, Artificial Sequence
  Description of Artificial Sequence: Synthetic peptide
  Seed: VVLQAAIPLTSCGSSPVPG (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPG

SEQ ID NO: 341471 - protein, 20 aa, Artificial Sequence
  Description of Artificial Sequence: Synthetic peptide
  Seed: VVLQAAIPLTSCGSSPVPGT (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGT

SEQ ID NO: 341472 - protein, 20 aa, Artificial Sequence
  Description of Artificial Sequence: Synthetic peptide
  Seed: VVLQAAIPLTSCGSSPVPGT (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGT

SEQ ID NO: 341473 - protein, 21 aa, Artificial Sequence
  Description of Artificial Sequence: Synthetic peptide
  Seed: VVLQAAIPLTSCGSSPVPGTT (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGTT

SEQ ID NO: 341474 - protein, 21 aa, Artificial Sequence
  Description of Artificial Sequence: Synthetic peptide
  Seed: VVLQAAIPLTSCGSSPVPGTT (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGTT

SEQ ID NO: 341475 - protein, 21 aa, Artificial Sequence
  Description of Artificial Sequence: Synthetic peptide
  Seed: VVLQAAIPLTSCGSSPVPGTT (PMEL_HUMAN)
  Core: SCGSSPVPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPLTXCGXSXVPXTT

SEQ ID NO: 341476 - protein, 22 aa, Artificial Sequence
  Description of Artificial Sequence: Synthetic peptide
  Seed: VVLQAAIPLTSCGSSPVPGTTD (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGTTD

SEQ ID NO: 341477 - protein, 22 aa, Artificial Sequence
  Description of Artificial Sequence: Synthetic peptide
  Seed: VVLQAAIPLTSCGSSPVPGTTD (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGTTD

SEQ ID NO: 341478 - protein, 22 aa, Artificial Sequence
  Description of Artificial Sequence: Synthetic peptide
  Seed: VVLQAAIPLTSCGSSPVPGTTD (PMEL_HUMAN)
  Core: SCGSSPVPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPLTXCGXSXVPXTTD

SEQ ID NO: 341479 - protein, 23 aa, Artificial Sequence
  Description of Artificial Sequence: Synthetic peptide
  Seed: VVLQAAIPLTSCGSSPVPGTTDG (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGTTDG

SEQ ID NO: 341480 - protein, 23 aa, Artificial Sequence
  Description of Artificial Sequence: Synthetic peptide
  Seed: VVLQAAIPLTSCGSSPVPGTTDG (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGTTDG

SEQ ID NO: 341481 - protein, 23 aa, Artificial Sequence
  Description of Artificial Sequence: Synthetic peptide
  Seed: VVLQAAIPLTSCGSSPVPGTTDG (PMEL_HUMAN)
  Core: SCGSSPVPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPLTXCGXSXVPXTTDG

SEQ ID NO: 341482 - protein, 24 aa, Artificial Sequence
  Description of Artificial Sequence: Synthetic peptide
  Seed: VVLQAAIPLTSCGSSPVPGTTDGH (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGTTDGH

SEQ ID NO: 341483 - protein, 24 aa, Artificial Sequence
  Description of Artificial Sequence: Synthetic peptide
  Seed: VVLQAAIPLTSCGSSPVPGTTDGH (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGTTDGH

SEQ ID NO: 341484 - protein, 24 aa, Artificial Sequence
  Description of Artificial Sequence: Synthetic peptide
  Seed: VVLQAAIPLTSCGSSPVPGTTDGH (PMEL_HUMAN)
  Core: SCGSSPVPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPLTXCGXSXVPXTTDGH

SEQ ID NO: 341485 - protein, 25 aa, Artificial Sequence
  Description of Artificial Sequence: Synthetic peptide
  Seed: VVLQAAIPLTSCGSSPVPGTTDGHR (PMEL_HUMAN)
  Core: LQAAIPLTS
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXQAXIXLTXCGSSPVPGTTDGHR

SEQ ID NO: 341486 - protein, 25 aa, Artificial Sequence
  Description of Artificial Sequence: Synthetic peptide
  Seed: VVLQAAIPLTSCGSSPVPGTTDGHR (PMEL_HUMAN)
  Core: LTSCGSSPV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPXTSXGXSPXPGTTDGHR

SEQ ID NO: 341487 - protein, 25 aa, Artificial Sequence
  Description of Artificial Sequence: Synthetic peptide
  Seed: VVLQAAIPLTSCGSSPVPGTTDGHR (PMEL_HUMAN)
  Core: SCGSSPVPG
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLQAAIPLTXCGXSXVPXTTDGHR

SEQ ID NO: 341488 - protein, 13 aa, Artificial Sequence
  Description of Artificial Sequence: Synthetic peptide
  Seed: VVLSGTTAAQVTT (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTT

SEQ ID NO: 341489 - protein, 14 aa, Artificial Sequence
  Description of Artificial Sequence: Synthetic peptide
  Seed: VVLSGTTAAQVTTT (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTT

SEQ ID NO: 341490 - protein, 15 aa, Artificial Sequence
  Description of Artificial Sequence: Synthetic peptide
  Seed: VVLSGTTAAQVTTTE (PMEL_HUMAN)
  Core: VLSGTTAAQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLSXTXAAXVTTTE

SEQ ID NO: 341491 - protein, 15 aa, Artificial Sequence
  Description of Artificial Sequence: Synthetic peptide
  Seed: VVLSGTTAAQVTTTE (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTE

SEQ ID NO: 341492 - protein, 15 aa, Artificial Sequence
  Description of Artificial Sequence: Synthetic peptide
  Seed: VVLSGTTAAQVTTTE (PMEL_HUMAN)
  Core: SGTTAAQVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXGTXAXQVXTTE

SEQ ID NO: 341493 - protein, 15 aa, Artificial Sequence
  Description of Artificial Sequence: Synthetic peptide
  Seed: VVLSGTTAAQVTTTE (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXE

SEQ ID NO: 341494 - protein, 16 aa, Artificial Sequence
  Description of Artificial Sequence: Synthetic peptide
  Seed: VVLSGTTAAQVTTTEW (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEW

SEQ ID NO: 341495 - protein, 16 aa, Artificial Sequence
  Description of Artificial Sequence: Synthetic peptide
  Seed: VVLSGTTAAQVTTTEW (PMEL_HUMAN)
  Core: SGTTAAQVT
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVLXGTXAXQVXTTEW

SEQ ID NO: 341496 - protein, 16 aa, Artificial Sequence
  Description of Artificial Sequence: Synthetic peptide
  Seed: VVLSGTTAAQVTTTEW (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEW

SEQ ID NO: 341497 - protein, 17 aa, Artificial Sequence
  Description of Artificial Sequence: Synthetic peptide
  Seed: VVLSGTTAAQVTTTEWV (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWV

SEQ ID NO: 341498 - protein, 17 aa, Artificial Sequence
  Description of Artificial Sequence: Synthetic peptide
  Seed: VVLSGTTAAQVTTTEWV (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWV

SEQ ID NO: 341499 - protein, 18 aa, Artificial Sequence
  Description of Artificial Sequence: Synthetic peptide
  Seed: VVLSGTTAAQVTTTEWVE (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVE

SEQ ID NO: 341500 - protein, 18 aa, Artificial Sequence
  Description of Artificial Sequence: Synthetic peptide
  Seed: VVLSGTTAAQVTTTEWVE (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVE

SEQ ID NO: 341501 - protein, 19 aa, Artificial Sequence
  Description of Artificial Sequence: Synthetic peptide
  Seed: VVLSGTTAAQVTTTEWVET (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVET

SEQ ID NO: 341502 - protein, 19 aa, Artificial Sequence
  Description of Artificial Sequence: Synthetic peptide
  Seed: VVLSGTTAAQVTTTEWVET (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVET

SEQ ID NO: 341503 - protein, 19 aa, Artificial Sequence
  Description of Artificial Sequence: Synthetic peptide
  Seed: VVLSGTTAAQVTTTEWVET (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXT

SEQ ID NO: 341504 - protein, 20 aa, Artificial Sequence
  Description of Artificial Sequence: Synthetic peptide
  Seed: VVLSGTTAAQVTTTEWVETT (PMEL_HUMAN)
  Core: VLSGTTAAQ
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXLSXTXAAXVTTTEWVETT

SEQ ID NO: 341505 - protein, 20 aa, Artificial Sequence
  Description of Artificial Sequence: Synthetic peptide
  Seed: VVLSGTTAAQVTTTEWVETT (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETT

SEQ ID NO: 341506 - protein, 20 aa, Artificial Sequence
  Description of Artificial Sequence: Synthetic peptide
  Seed: VVLSGTTAAQVTTTEWVETT (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETT

SEQ ID NO: 341507 - protein, 20 aa, Artificial Sequence
  Description of Artificial Sequence: Synthetic peptide
  Seed: VVLSGTTAAQVTTTEWVETT (PMEL_HUMAN)
  Core: AQVTTTEWV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAXQVXTXEWXETT

SEQ ID NO: 341508 - protein, 20 aa, Artificial Sequence
  Description of Artificial Sequence: Synthetic peptide
  Seed: VVLSGTTAAQVTTTEWVETT (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTT

SEQ ID NO: 341509 - protein, 20 aa, Artificial Sequence
  Description of Artificial Sequence: Synthetic peptide
  Seed: VVLSGTTAAQVTTTEWVETT (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXT

SEQ ID NO: 341510 - protein, 21 aa, Artificial Sequence
  Description of Artificial Sequence: Synthetic peptide
  Seed: VVLSGTTAAQVTTTEWVETTA (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETTA

SEQ ID NO: 341511 - protein, 21 aa, Artificial Sequence
  Description of Artificial Sequence: Synthetic peptide
  Seed: VVLSGTTAAQVTTTEWVETTA (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETTA

SEQ ID NO: 341512 - protein, 21 aa, Artificial Sequence
  Description of Artificial Sequence: Synthetic peptide
  Seed: VVLSGTTAAQVTTTEWVETTA (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTTA

SEQ ID NO: 341513 - protein, 21 aa, Artificial Sequence
  Description of Artificial Sequence: Synthetic peptide
  Seed: VVLSGTTAAQVTTTEWVETTA (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXTA

SEQ ID NO: 341514 - protein, 22 aa, Artificial Sequence
  Description of Artificial Sequence: Synthetic peptide
  Seed: VVLSGTTAAQVTTTEWVETTAR (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETTAR

SEQ ID NO: 341515 - protein, 22 aa, Artificial Sequence
  Description of Artificial Sequence: Synthetic peptide
  Seed: VVLSGTTAAQVTTTEWVETTAR (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETTAR

SEQ ID NO: 341516 - protein, 22 aa, Artificial Sequence
  Description of Artificial Sequence: Synthetic peptide
  Seed: VVLSGTTAAQVTTTEWVETTAR (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTTAR

SEQ ID NO: 341517 - protein, 22 aa, Artificial Sequence
  Description of Artificial Sequence: Synthetic peptide
  Seed: VVLSGTTAAQVTTTEWVETTAR (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXTAR

SEQ ID NO: 341518 - protein, 23 aa, Artificial Sequence
  Description of Artificial Sequence: Synthetic peptide
  Seed: VVLSGTTAAQVTTTEWVETTARE (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETTARE

SEQ ID NO: 341519 - protein, 23 aa, Artificial Sequence
  Description of Artificial Sequence: Synthetic peptide
  Seed: VVLSGTTAAQVTTTEWVETTARE (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETTARE

SEQ ID NO: 341520 - protein, 23 aa, Artificial Sequence
  Description of Artificial Sequence: Synthetic peptide
  Seed: VVLSGTTAAQVTTTEWVETTARE (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTTARE

SEQ ID NO: 341521 - protein, 23 aa, Artificial Sequence
  Description of Artificial Sequence: Synthetic peptide
  Seed: VVLSGTTAAQVTTTEWVETTARE (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXTARE

SEQ ID NO: 341522 - protein, 23 aa, Artificial Sequence
  Description of Artificial Sequence: Synthetic peptide
  Seed: VVLSGTTAAQVTTTEWVETTARE (PMEL_HUMAN)
  Core: TTTEWVETT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQVXTTXWXETXARE

SEQ ID NO: 341523 - protein, 24 aa, Artificial Sequence
  Description of Artificial Sequence: Synthetic peptide
  Seed: VVLSGTTAAQVTTTEWVETTAREL (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETTAREL

SEQ ID NO: 341524 - protein, 24 aa, Artificial Sequence
  Description of Artificial Sequence: Synthetic peptide
  Seed: VVLSGTTAAQVTTTEWVETTAREL (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETTAREL

SEQ ID NO: 341525 - protein, 24 aa, Artificial Sequence
  Description of Artificial Sequence: Synthetic peptide
  Seed: VVLSGTTAAQVTTTEWVETTAREL (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTTAREL

SEQ ID NO: 341526 - protein, 24 aa, Artificial Sequence
  Description of Artificial Sequence: Synthetic peptide
  Seed: VVLSGTTAAQVTTTEWVETTAREL (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXTAREL

SEQ ID NO: 341527 - protein, 24 aa, Artificial Sequence
  Description of Artificial Sequence: Synthetic peptide
  Seed: VVLSGTTAAQVTTTEWVETTAREL (PMEL_HUMAN)
  Core: TTTEWVETT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQVXTTXWXETXAREL

SEQ ID NO: 341528 - protein, 24 aa, Artificial Sequence
  Description of Artificial Sequence: Synthetic peptide
  Seed: VVLSGTTAAQVTTTEWVETTAREL (PMEL_HUMAN)
  Core: WVETTAREL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQVTTTEXVEXTXREX

SEQ ID NO: 341529 - protein, 25 aa, Artificial Sequence
  Description of Artificial Sequence: Synthetic peptide
  Seed: VVLSGTTAAQVTTTEWVETTARELP (PMEL_HUMAN)
  Core: LSGTTAAQV
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
VVXSGXTXAQXTTTEWVETTARELP

SEQ ID NO: 341530 - protein, 25 aa, Artificial Sequence
  Description of Artificial Sequence: Synthetic peptide
  Seed: VVLSGTTAAQVTTTEWVETTARELP (PMEL_HUMAN)
  Core: TTAAQVTTT
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGXTAXQXTTXEWVETTARELP

SEQ ID NO: 341531 - protein, 25 aa, Artificial Sequence
  Description of Artificial Sequence: Synthetic peptide
  Seed: VVLSGTTAAQVTTTEWVETTARELP (PMEL_HUMAN)
  Core: QVTTTEWVE
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAXVTXTXWVXTTARELP

SEQ ID NO: 341532 - protein, 25 aa, Artificial Sequence
  Description of Artificial Sequence: Synthetic peptide
  Seed: VVLSGTTAAQVTTTEWVETTARELP (PMEL_HUMAN)
  Core: VTTTEWVET
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQXTTXEXVEXTARELP

SEQ ID NO: 341533 - protein, 25 aa, Artificial Sequence
  Description of Artificial Sequence: Synthetic peptide
  Seed: VVLSGTTAAQVTTTEWVETTARELP (PMEL_HUMAN)
  Core: TTTEWVETT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQVXTTXWXETXARELP

SEQ ID NO: 341534 - protein, 25 aa, Artificial Sequence
  Description of Artificial Sequence: Synthetic peptide
  Seed: VVLSGTTAAQVTTTEWVETTARELP (PMEL_HUMAN)
  Core: WVETTAREL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VVLSGTTAAQVTTTEXVEXTXREXP

SEQ ID NO: 341535 - protein, 14 aa, Artificial Sequence
  Description of Artificial Sequence: Synthetic peptide
  Seed: VVSTQLIMPGQEAG (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXG

SEQ ID NO: 341536 - protein, 15 aa, Artificial Sequence
  Description of Artificial Sequence: Synthetic peptide
  Seed: VVSTQLIMPGQEAGL (PMEL_HUMAN)
  Core: VSTQLIMPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXSTXLXMPXQEAGL

SEQ ID NO: 341537 - protein, 15 aa, Artificial Sequence
  Description of Artificial Sequence: Synthetic peptide
  Seed: VVSTQLIMPGQEAGL (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGL

SEQ ID NO: 341538 - protein, 15 aa, Artificial Sequence
  Description of Artificial Sequence: Synthetic peptide
  Seed: VVSTQLIMPGQEAGL (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGX

SEQ ID NO: 341539 - protein, 16 aa, Artificial Sequence
  Description of Artificial Sequence: Synthetic peptide
  Seed: VVSTQLIMPGQEAGLG (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLG

SEQ ID NO: 341540 - protein, 16 aa, Artificial Sequence
  Description of Artificial Sequence: Synthetic peptide
  Seed: VVSTQLIMPGQEAGLG (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGXG

SEQ ID NO: 341541 - protein, 17 aa, Artificial Sequence
  Description of Artificial Sequence: Synthetic peptide
  Seed: VVSTQLIMPGQEAGLGQ (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQ

SEQ ID NO: 341542 - protein, 19 aa, Artificial Sequence
  Description of Artificial Sequence: Synthetic peptide
  Seed: VVSTQLIMPGQEAGLGQVP (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVP

SEQ ID NO: 341543 - protein, 20 aa, Artificial Sequence
  Description of Artificial Sequence: Synthetic peptide
  Seed: VVSTQLIMPGQEAGLGQVPL (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPL

SEQ ID NO: 341544 - protein, 20 aa, Artificial Sequence
  Description of Artificial Sequence: Synthetic peptide
  Seed: VVSTQLIMPGQEAGLGQVPL (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGXGQVPL

SEQ ID NO: 341545 - protein, 21 aa, Artificial Sequence
  Description of Artificial Sequence: Synthetic peptide
  Seed: VVSTQLIMPGQEAGLGQVPLI (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPLI

SEQ ID NO: 341546 - protein, 21 aa, Artificial Sequence
  Description of Artificial Sequence: Synthetic peptide
  Seed: VVSTQLIMPGQEAGLGQVPLI (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGXGQVPLI

SEQ ID NO: 341547 - protein, 22 aa, Artificial Sequence
  Description of Artificial Sequence: Synthetic peptide
  Seed: VVSTQLIMPGQEAGLGQVPLIV (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPLIV

SEQ ID NO: 341548 - protein, 22 aa, Artificial Sequence
  Description of Artificial Sequence: Synthetic peptide
  Seed: VVSTQLIMPGQEAGLGQVPLIV (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGXGQVPLIV

SEQ ID NO: 341549 - protein, 23 aa, Artificial Sequence
  Description of Artificial Sequence: Synthetic peptide
  Seed: VVSTQLIMPGQEAGLGQVPLIVG (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPLIVG

SEQ ID NO: 341550 - protein, 23 aa, Artificial Sequence
  Description of Artificial Sequence: Synthetic peptide
  Seed: VVSTQLIMPGQEAGLGQVPLIVG (PMEL_HUMAN)
  Core: IMPGQEAGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLXMPXQXAGXGQVPLIVG

SEQ ID NO: 341551 - protein, 24 aa, Artificial Sequence
  Description of Artificial Sequence: Synthetic peptide
  Seed: VVSTQLIMPGQEAGLGQVPLIVGI (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPLIVGI

SEQ ID NO: 341552 - protein, 24 aa, Artificial Sequence
  Description of Artificial Sequence: Synthetic peptide
  Seed: VVSTQLIMPGQEAGLGQVPLIVGI (PMEL_HUMAN)
  Core: AGLGQVPLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLIMPGQEXGLXQXPLXVGI

SEQ ID NO: 341553 - protein, 24 aa, Artificial Sequence
  Description of Artificial Sequence: Synthetic peptide
  Seed: VVSTQLIMPGQEAGLGQVPLIVGI (PMEL_HUMAN)
  Core: GLGQVPLIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLIMPGQEAXLGXVXLIXGI

SEQ ID NO: 341554 - protein, 25 aa, Artificial Sequence
  Description of Artificial Sequence: Synthetic peptide
  Seed: VVSTQLIMPGQEAGLGQVPLIVGIL (PMEL_HUMAN)
  Core: QLIMPGQEA
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VVSTXLIXPXQEXGLGQVPLIVGIL

SEQ ID NO: 341555 - protein, 25 aa, Artificial Sequence
  Description of Artificial Sequence: Synthetic peptide
  Seed: VVSTQLIMPGQEAGLGQVPLIVGIL (PMEL_HUMAN)
  Core: AGLGQVPLI
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLIMPGQEXGLXQXPLXVGIL

SEQ ID NO: 341556 - protein, 25 aa, Artificial Sequence
  Description of Artificial Sequence: Synthetic peptide
  Seed: VVSTQLIMPGQEAGLGQVPLIVGIL (PMEL_HUMAN)
  Core: GLGQVPLIV
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLIMPGQEAXLGXVXLIXGIL

SEQ ID NO: 341557 - protein, 25 aa, Artificial Sequence
  Description of Artificial Sequence: Synthetic peptide
  Seed: VVSTQLIMPGQEAGLGQVPLIVGIL (PMEL_HUMAN)
  Core: LGQVPLIVG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VVSTQLIMPGQEAGXGQXPXIVXIL

SEQ ID NO: 341558 - protein, 15 aa, Artificial Sequence
  Description of Artificial Sequence: Synthetic peptide
  Seed: VVTHTYLEPGPVTAQ (PMEL_HUMAN)
  Core: HTYLEPGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVTXTYXEXGPXTAQ

SEQ ID NO: 341559 - protein, 16 aa, Artificial Sequence
  Description of Artificial Sequence: Synthetic peptide
  Seed: VVTHTYLEPGPVTAQV (PMEL_HUMAN)
  Core: VTHTYLEPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXTHXYXEPXPVTAQV

SEQ ID NO: 341560 - protein, 16 aa, Artificial Sequence
  Description of Artificial Sequence: Synthetic peptide
  Seed: VVTHTYLEPGPVTAQV (PMEL_HUMAN)
  Core: HTYLEPGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVTXTYXEXGPXTAQV

SEQ ID NO: 341561 - protein, 17 aa, Artificial Sequence
  Description of Artificial Sequence: Synthetic peptide
  Seed: VVTHTYLEPGPVTAQVV (PMEL_HUMAN)
  Core: VTHTYLEPG
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXTHXYXEPXPVTAQVV

SEQ ID NO: 341562 - protein, 17 aa, Artificial Sequence
  Description of Artificial Sequence: Synthetic peptide
  Seed: VVTHTYLEPGPVTAQVV (PMEL_HUMAN)
  Core: HTYLEPGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVTXTYXEXGPXTAQVV

SEQ ID NO: 341563 - protein, 17 aa, Artificial Sequence
  Description of Artificial Sequence: Synthetic peptide
  Seed: VVTHTYLEPGPVTAQVV (PMEL_HUMAN)
  Core: LEPGPVTAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYXEPXPXTAXVV

SEQ ID NO: 341564 - protein, 18 aa, Artificial Sequence
  Description of Artificial Sequence: Synthetic peptide
  Seed: VVTHTYLEPGPVTAQVVL (PMEL_HUMAN)
  Core: PGPVTAQVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEXGPXTXQVXL

SEQ ID NO: 341565 - protein, 19 aa, Artificial Sequence
  Description of Artificial Sequence: Synthetic peptide
  Seed: VVTHTYLEPGPVTAQVVLQ (PMEL_HUMAN)
  Core: LEPGPVTAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYXEPXPXTAXVVLQ

SEQ ID NO: 341566 - protein, 19 aa, Artificial Sequence
  Description of Artificial Sequence: Synthetic peptide
  Seed: VVTHTYLEPGPVTAQVVLQ (PMEL_HUMAN)
  Core: PGPVTAQVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEXGPXTXQVXLQ

SEQ ID NO: 341567 - protein, 19 aa, Artificial Sequence
  Description of Artificial Sequence: Synthetic peptide
  Seed: VVTHTYLEPGPVTAQVVLQ (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLX

SEQ ID NO: 341568 - protein, 20 aa, Artificial Sequence
  Description of Artificial Sequence: Synthetic peptide
  Seed: VVTHTYLEPGPVTAQVVLQA (PMEL_HUMAN)
  Core: HTYLEPGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VVTXTYXEXGPXTAQVVLQA

SEQ ID NO: 341569 - protein, 20 aa, Artificial Sequence
  Description of Artificial Sequence: Synthetic peptide
  Seed: VVTHTYLEPGPVTAQVVLQA (PMEL_HUMAN)
  Core: YLEPGPVTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTXLEXGXVTXQVVLQA

SEQ ID NO: 341570 - protein, 20 aa, Artificial Sequence
  Description of Artificial Sequence: Synthetic peptide
  Seed: VVTHTYLEPGPVTAQVVLQA (PMEL_HUMAN)
  Core: LEPGPVTAQ
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYXEPXPXTAXVVLQA

SEQ ID NO: 341571 - protein, 20 aa, Artificial Sequence
  Description of Artificial Sequence: Synthetic peptide
  Seed: VVTHTYLEPGPVTAQVVLQA (PMEL_HUMAN)
  Core: PGPVTAQVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEXGPXTXQVXLQA

SEQ ID NO: 341572 - protein, 20 aa, Artificial Sequence
  Description of Artificial Sequence: Synthetic peptide
  Seed: VVTHTYLEPGPVTAQVVLQA (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXA

SEQ ID NO: 341573 - protein, 20 aa, Artificial Sequence
  Description of Artificial Sequence: Synthetic peptide
  Seed: VVTHTYLEPGPVTAQVVLQA (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQX

SEQ ID NO: 341574 - protein, 21 aa, Artificial Sequence
  Description of Artificial Sequence: Synthetic peptide
  Seed: VVTHTYLEPGPVTAQVVLQAA (PMEL_HUMAN)
  Core: YLEPGPVTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTXLEXGXVTXQVVLQAA

SEQ ID NO: 341575 - protein, 21 aa, Artificial Sequence
  Description of Artificial Sequence: Synthetic peptide
  Seed: VVTHTYLEPGPVTAQVVLQAA (PMEL_HUMAN)
  Core: PGPVTAQVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEXGPXTXQVXLQAA

SEQ ID NO: 341576 - protein, 21 aa, Artificial Sequence
  Description of Artificial Sequence: Synthetic peptide
  Seed: VVTHTYLEPGPVTAQVVLQAA (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXAA

SEQ ID NO: 341577 - protein, 21 aa, Artificial Sequence
  Description of Artificial Sequence: Synthetic peptide
  Seed: VVTHTYLEPGPVTAQVVLQAA (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQXA

SEQ ID NO: 341578 - protein, 22 aa, Artificial Sequence
  Description of Artificial Sequence: Synthetic peptide
  Seed: VVTHTYLEPGPVTAQVVLQAAI (PMEL_HUMAN)
  Core: YLEPGPVTA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTXLEXGXVTXQVVLQAAI

SEQ ID NO: 341579 - protein, 22 aa, Artificial Sequence
  Description of Artificial Sequence: Synthetic peptide
  Seed: VVTHTYLEPGPVTAQVVLQAAI (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXAAI

SEQ ID NO: 341580 - protein, 22 aa, Artificial Sequence
  Description of Artificial Sequence: Synthetic peptide
  Seed: VVTHTYLEPGPVTAQVVLQAAI (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQXAI

SEQ ID NO: 341581 - protein, 22 aa, Artificial Sequence
  Description of Artificial Sequence: Synthetic peptide
  Seed: VVTHTYLEPGPVTAQVVLQAAI (PMEL_HUMAN)
  Core: TAQVVLQAA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPVXAQXVXQAXI

SEQ ID NO: 341582 - protein, 23 aa, Artificial Sequence
  Description of Artificial Sequence: Synthetic peptide
  Seed: VVTHTYLEPGPVTAQVVLQAAIP (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXAAIP

SEQ ID NO: 341583 - protein, 23 aa, Artificial Sequence
  Description of Artificial Sequence: Synthetic peptide
  Seed: VVTHTYLEPGPVTAQVVLQAAIP (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQXAIP

SEQ ID NO: 341584 - protein, 23 aa, Artificial Sequence
  Description of Artificial Sequence: Synthetic peptide
  Seed: VVTHTYLEPGPVTAQVVLQAAIP (PMEL_HUMAN)
  Core: TAQVVLQAA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPVXAQXVXQAXIP

SEQ ID NO: 341585 - protein, 24 aa, Artificial Sequence
  Description of Artificial Sequence: Synthetic peptide
  Seed: VVTHTYLEPGPVTAQVVLQAAIPL (PMEL_HUMAN)
  Core: PGPVTAQVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEXGPXTXQVXLQAAIPL

SEQ ID NO: 341586 - protein, 24 aa, Artificial Sequence
  Description of Artificial Sequence: Synthetic peptide
  Seed: VVTHTYLEPGPVTAQVVLQAAIPL (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXAAIPL

SEQ ID NO: 341587 - protein, 24 aa, Artificial Sequence
  Description of Artificial Sequence: Synthetic peptide
  Seed: VVTHTYLEPGPVTAQVVLQAAIPL (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQXAIPL

SEQ ID NO: 341588 - protein, 24 aa, Artificial Sequence
  Description of Artificial Sequence: Synthetic peptide
  Seed: VVTHTYLEPGPVTAQVVLQAAIPL (PMEL_HUMAN)
  Core: TAQVVLQAA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPVXAQXVXQAXIPL

SEQ ID NO: 341589 - protein, 25 aa, Artificial Sequence
  Description of Artificial Sequence: Synthetic peptide
  Seed: VVTHTYLEPGPVTAQVVLQAAIPLT (PMEL_HUMAN)
  Core: PVTAQVVLQ
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGXVTXQXVLXAAIPLT

SEQ ID NO: 341590 - protein, 25 aa, Artificial Sequence
  Description of Artificial Sequence: Synthetic peptide
  Seed: VVTHTYLEPGPVTAQVVLQAAIPLT (PMEL_HUMAN)
  Core: VTAQVVLQA
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPXTAXVXLQXAIPLT

SEQ ID NO: 341591 - protein, 25 aa, Artificial Sequence
  Description of Artificial Sequence: Synthetic peptide
  Seed: VVTHTYLEPGPVTAQVVLQAAIPLT (PMEL_HUMAN)
  Core: TAQVVLQAA
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPVXAQXVXQAXIPLT

SEQ ID NO: 341592 - protein, 25 aa, Artificial Sequence
  Description of Artificial Sequence: Synthetic peptide
  Seed: VVTHTYLEPGPVTAQVVLQAAIPLT (PMEL_HUMAN)
  Core: VVLQAAIPL
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VVTHTYLEPGPVTAQXVLXAXIPXT

SEQ ID NO: 341593 - protein, 14 aa, Artificial Sequence
  Description of Artificial Sequence: Synthetic peptide
  Seed: VWGGQPVYPQETDD (PMEL_HUMAN)
  Core: GQPVYPQET
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWGXQPXYXQEXDD

SEQ ID NO: 341594 - protein, 15 aa, Artificial Sequence
  Description of Artificial Sequence: Synthetic peptide
  Seed: VWGGQPVYPQETDDA (PMEL_HUMAN)
  Core: GQPVYPQET
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWGXQPXYXQEXDDA

SEQ ID NO: 341595 - protein, 15 aa, Artificial Sequence
  Description of Artificial Sequence: Synthetic peptide
  Seed: VWGGQPVYPQETDDA (PMEL_HUMAN)
  Core: VYPQETDDA
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VWGGQPXYPXEXDDX

SEQ ID NO: 341596 - protein, 16 aa, Artificial Sequence
  Description of Artificial Sequence: Synthetic peptide
  Seed: VWGGQPVYPQETDDAC (PMEL_HUMAN)
  Core: GQPVYPQET
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWGXQPXYXQEXDDAC

SEQ ID NO: 341597 - protein, 14 aa, Artificial Sequence
  Description of Artificial Sequence: Synthetic peptide
  Seed: VWKTWGQYWQVLGG (PMEL_HUMAN)
  Core: TWGQYWQVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWKXWGXYXQVXGG

SEQ ID NO: 341598 - protein, 15 aa, Artificial Sequence
  Description of Artificial Sequence: Synthetic peptide
  Seed: VWKTWGQYWQVLGGP (PMEL_HUMAN)
  Core: TWGQYWQVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWKXWGXYXQVXGGP

SEQ ID NO: 341599 - protein, 15 aa, Artificial Sequence
  Description of Artificial Sequence: Synthetic peptide
  Seed: VWKTWGQYWQVLGGP (PMEL_HUMAN)
  Core: WGQYWQVLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VWKTXGQXWXVLXGP

SEQ ID NO: 341600 - protein, 16 aa, Artificial Sequence
  Description of Artificial Sequence: Synthetic peptide
  Seed: VWKTWGQYWQVLGGPV (PMEL_HUMAN)
  Core: TWGQYWQVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWKXWGXYXQVXGGPV

SEQ ID NO: 341601 - protein, 16 aa, Artificial Sequence
  Description of Artificial Sequence: Synthetic peptide
  Seed: VWKTWGQYWQVLGGPV (PMEL_HUMAN)
  Core: WGQYWQVLG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VWKTXGQXWXVLXGPV

SEQ ID NO: 341602 - protein, 16 aa, Artificial Sequence
  Description of Artificial Sequence: Synthetic peptide
  Seed: VWKTWGQYWQVLGGPV (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPV

SEQ ID NO: 341603 - protein, 16 aa, Artificial Sequence
  Description of Artificial Sequence: Synthetic peptide
  Seed: VWKTWGQYWQVLGGPV (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPX

SEQ ID NO: 341604 - protein, 17 aa, Artificial Sequence
  Description of Artificial Sequence: Synthetic peptide
  Seed: VWKTWGQYWQVLGGPVS (PMEL_HUMAN)
  Core: TWGQYWQVL
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VWKXWGXYXQVXGGPVS

SEQ ID NO: 341605 - protein, 17 aa, Artificial Sequence
  Description of Artificial Sequence: Synthetic peptide
  Seed: VWKTWGQYWQVLGGPVS (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVS

SEQ ID NO: 341606 - protein, 17 aa, Artificial Sequence
  Description of Artificial Sequence: Synthetic peptide
  Seed: VWKTWGQYWQVLGGPVS (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXS

SEQ ID NO: 341607 - protein, 18 aa, Artificial Sequence
  Description of Artificial Sequence: Synthetic peptide
  Seed: VWKTWGQYWQVLGGPVSG (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSG

SEQ ID NO: 341608 - protein, 18 aa, Artificial Sequence
  Description of Artificial Sequence: Synthetic peptide
  Seed: VWKTWGQYWQVLGGPVSG (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSG

SEQ ID NO: 341609 - protein, 18 aa, Artificial Sequence
  Description of Artificial Sequence: Synthetic peptide
  Seed: VWKTWGQYWQVLGGPVSG (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXG

SEQ ID NO: 341610 - protein, 19 aa, Artificial Sequence
  Description of Artificial Sequence: Synthetic peptide
  Seed: VWKTWGQYWQVLGGPVSGL (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGL

SEQ ID NO: 341611 - protein, 19 aa, Artificial Sequence
  Description of Artificial Sequence: Synthetic peptide
  Seed: VWKTWGQYWQVLGGPVSGL (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGL

SEQ ID NO: 341612 - protein, 19 aa, Artificial Sequence
  Description of Artificial Sequence: Synthetic peptide
  Seed: VWKTWGQYWQVLGGPVSGL (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGL

SEQ ID NO: 341613 - protein, 20 aa, Artificial Sequence
  Description of Artificial Sequence: Synthetic peptide
  Seed: VWKTWGQYWQVLGGPVSGLS (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLS

SEQ ID NO: 341614 - protein, 20 aa, Artificial Sequence
  Description of Artificial Sequence: Synthetic peptide
  Seed: VWKTWGQYWQVLGGPVSGLS (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLS

SEQ ID NO: 341615 - protein, 20 aa, Artificial Sequence
  Description of Artificial Sequence: Synthetic peptide
  Seed: VWKTWGQYWQVLGGPVSGLS (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLS

SEQ ID NO: 341616 - protein, 20 aa, Artificial Sequence
  Description of Artificial Sequence: Synthetic peptide
  Seed: VWKTWGQYWQVLGGPVSGLS (PMEL_HUMAN)
  Core: VLGGPVSGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQXLGXPXSGXS

SEQ ID NO: 341617 - protein, 21 aa, Artificial Sequence
  Description of Artificial Sequence: Synthetic peptide
  Seed: VWKTWGQYWQVLGGPVSGLSI (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLSI

SEQ ID NO: 341618 - protein, 21 aa, Artificial Sequence
  Description of Artificial Sequence: Synthetic peptide
  Seed: VWKTWGQYWQVLGGPVSGLSI (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLSI

SEQ ID NO: 341619 - protein, 21 aa, Artificial Sequence
  Description of Artificial Sequence: Synthetic peptide
  Seed: VWKTWGQYWQVLGGPVSGLSI (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLSI

SEQ ID NO: 341620 - protein, 21 aa, Artificial Sequence
  Description of Artificial Sequence: Synthetic peptide
  Seed: VWKTWGQYWQVLGGPVSGLSI (PMEL_HUMAN)
  Core: VLGGPVSGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQXLGXPXSGXSI

SEQ ID NO: 341621 - protein, 22 aa, Artificial Sequence
  Description of Artificial Sequence: Synthetic peptide
  Seed: VWKTWGQYWQVLGGPVSGLSIG (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLSIG

SEQ ID NO: 341622 - protein, 22 aa, Artificial Sequence
  Description of Artificial Sequence: Synthetic peptide
  Seed: VWKTWGQYWQVLGGPVSGLSIG (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLSIG

SEQ ID NO: 341623 - protein, 22 aa, Artificial Sequence
  Description of Artificial Sequence: Synthetic peptide
  Seed: VWKTWGQYWQVLGGPVSGLSIG (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLSIG

SEQ ID NO: 341624 - protein, 22 aa, Artificial Sequence
  Description of Artificial Sequence: Synthetic peptide
  Seed: VWKTWGQYWQVLGGPVSGLSIG (PMEL_HUMAN)
  Core: VLGGPVSGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQXLGXPXSGXSIG

SEQ ID NO: 341625 - protein, 23 aa, Artificial Sequence
  Description of Artificial Sequence: Synthetic peptide
  Seed: VWKTWGQYWQVLGGPVSGLSIGT (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLSIGT

SEQ ID NO: 341626 - protein, 23 aa, Artificial Sequence
  Description of Artificial Sequence: Synthetic peptide
  Seed: VWKTWGQYWQVLGGPVSGLSIGT (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLSIGT

SEQ ID NO: 341627 - protein, 23 aa, Artificial Sequence
  Description of Artificial Sequence: Synthetic peptide
  Seed: VWKTWGQYWQVLGGPVSGLSIGT (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLSIGT

SEQ ID NO: 341628 - protein, 23 aa, Artificial Sequence
  Description of Artificial Sequence: Synthetic peptide
  Seed: VWKTWGQYWQVLGGPVSGLSIGT (PMEL_HUMAN)
  Core: VLGGPVSGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQXLGXPXSGXSIGT

SEQ ID NO: 341629 - protein, 24 aa, Artificial Sequence
  Description of Artificial Sequence: Synthetic peptide
  Seed: VWKTWGQYWQVLGGPVSGLSIGTG (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLSIGTG

SEQ ID NO: 341630 - protein, 24 aa, Artificial Sequence
  Description of Artificial Sequence: Synthetic peptide
  Seed: VWKTWGQYWQVLGGPVSGLSIGTG (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLSIGTG

SEQ ID NO: 341631 - protein, 24 aa, Artificial Sequence
  Description of Artificial Sequence: Synthetic peptide
  Seed: VWKTWGQYWQVLGGPVSGLSIGTG (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLSIGTG

SEQ ID NO: 341632 - protein, 24 aa, Artificial Sequence
  Description of Artificial Sequence: Synthetic peptide
  Seed: VWKTWGQYWQVLGGPVSGLSIGTG (PMEL_HUMAN)
  Core: VLGGPVSGL
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQXLGXPXSGXSIGTG

SEQ ID NO: 341633 - protein, 24 aa, Artificial Sequence
  Description of Artificial Sequence: Synthetic peptide
  Seed: VWKTWGQYWQVLGGPVSGLSIGTG (PMEL_HUMAN)
  Core: PVSGLSIGT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQVLGGXVSXLXIGXG

SEQ ID NO: 341634 - protein, 25 aa, Artificial Sequence
  Description of Artificial Sequence: Synthetic peptide
  Seed: VWKTWGQYWQVLGGPVSGLSIGTGR (PMEL_HUMAN)
  Core: GQYWQVLGG
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWXQYXQXLGXPVSGLSIGTGR

SEQ ID NO: 341635 - protein, 25 aa, Artificial Sequence
  Description of Artificial Sequence: Synthetic peptide
  Seed: VWKTWGQYWQVLGGPVSGLSIGTGR (PMEL_HUMAN)
  Core: YWQVLGGPV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQXWQXLXGPXSGLSIGTGR

SEQ ID NO: 341636 - protein, 25 aa, Artificial Sequence
  Description of Artificial Sequence: Synthetic peptide
  Seed: VWKTWGQYWQVLGGPVSGLSIGTGR (PMEL_HUMAN)
  Core: WQVLGGPVS
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYXQVXGXPVXGLSIGTGR

SEQ ID NO: 341637 - protein, 25 aa, Artificial Sequence
  Description of Artificial Sequence: Synthetic peptide
  Seed: VWKTWGQYWQVLGGPVSGLSIGTGR (PMEL_HUMAN)
  Core: PVSGLSIGT
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQVLGGXVSXLXIGXGR

SEQ ID NO: 341638 - protein, 25 aa, Artificial Sequence
  Description of Artificial Sequence: Synthetic peptide
  Seed: VWKTWGQYWQVLGGPVSGLSIGTGR (PMEL_HUMAN)
  Core: VSGLSIGTG
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
VWKTWGQYWQVLGGPXSGXSXGTXR

SEQ ID NO: 341639 - protein, 15 aa, Artificial Sequence
  Description of Artificial Sequence: Synthetic peptide
  Seed: VYHRRGSRSYVPLAH (PMEL_HUMAN)
  Core: YHRRGSRSY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHRXGXRSXVPLAH

SEQ ID NO: 341640 - protein, 15 aa, Artificial Sequence
  Description of Artificial Sequence: Synthetic peptide
  Seed: VYHRRGSRSYVPLAH (PMEL_HUMAN)
  Core: RRGSRSYVP
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VYHXRGXRXYVXLAH

SEQ ID NO: 341641 - protein, 15 aa, Artificial Sequence
  Description of Artificial Sequence: Synthetic peptide
  Seed: VYHRRGSRSYVPLAH (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXH

SEQ ID NO: 341642 - protein, 15 aa, Artificial Sequence
  Description of Artificial Sequence: Synthetic peptide
  Seed: VYHRRGSRSYVPLAH (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAX

SEQ ID NO: 341643 - protein, 16 aa, Artificial Sequence
  Description of Artificial Sequence: Synthetic peptide
  Seed: VYHRRGSRSYVPLAHS (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHS

SEQ ID NO: 341644 - protein, 16 aa, Artificial Sequence
  Description of Artificial Sequence: Synthetic peptide
  Seed: VYHRRGSRSYVPLAHS (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXS

SEQ ID NO: 341645 - protein, 16 aa, Artificial Sequence
  Description of Artificial Sequence: Synthetic peptide
  Seed: VYHRRGSRSYVPLAHS (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHX

SEQ ID NO: 341646 - protein, 17 aa, Artificial Sequence
  Description of Artificial Sequence: Synthetic peptide
  Seed: VYHRRGSRSYVPLAHSS (PMEL_HUMAN)
  Core: YHRRGSRSY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXHRXGXRSXVPLAHSS

SEQ ID NO: 341647 - protein, 17 aa, Artificial Sequence
  Description of Artificial Sequence: Synthetic peptide
  Seed: VYHRRGSRSYVPLAHSS (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSS

SEQ ID NO: 341648 - protein, 17 aa, Artificial Sequence
  Description of Artificial Sequence: Synthetic peptide
  Seed: VYHRRGSRSYVPLAHSS (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSS

SEQ ID NO: 341649 - protein, 17 aa, Artificial Sequence
  Description of Artificial Sequence: Synthetic peptide
  Seed: VYHRRGSRSYVPLAHSS (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXS

SEQ ID NO: 341650 - protein, 18 aa, Artificial Sequence
  Description of Artificial Sequence: Synthetic peptide
  Seed: VYHRRGSRSYVPLAHSSS (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSS

SEQ ID NO: 341651 - protein, 18 aa, Artificial Sequence
  Description of Artificial Sequence: Synthetic peptide
  Seed: VYHRRGSRSYVPLAHSSS (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSS

SEQ ID NO: 341652 - protein, 18 aa, Artificial Sequence
  Description of Artificial Sequence: Synthetic peptide
  Seed: VYHRRGSRSYVPLAHSSS (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSX

SEQ ID NO: 341653 - protein, 19 aa, Artificial Sequence
  Description of Artificial Sequence: Synthetic peptide
  Seed: VYHRRGSRSYVPLAHSSSA (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSSA

SEQ ID NO: 341654 - protein, 19 aa, Artificial Sequence
  Description of Artificial Sequence: Synthetic peptide
  Seed: VYHRRGSRSYVPLAHSSSA (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSA

SEQ ID NO: 341655 - protein, 19 aa, Artificial Sequence
  Description of Artificial Sequence: Synthetic peptide
  Seed: VYHRRGSRSYVPLAHSSSA (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSA

SEQ ID NO: 341656 - protein, 19 aa, Artificial Sequence
  Description of Artificial Sequence: Synthetic peptide
  Seed: VYHRRGSRSYVPLAHSSSA (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXA

SEQ ID NO: 341657 - protein, 20 aa, Artificial Sequence
  Description of Artificial Sequence: Synthetic peptide
  Seed: VYHRRGSRSYVPLAHSSSAF (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSSAF

SEQ ID NO: 341658 - protein, 20 aa, Artificial Sequence
  Description of Artificial Sequence: Synthetic peptide
  Seed: VYHRRGSRSYVPLAHSSSAF (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAF

SEQ ID NO: 341659 - protein, 20 aa, Artificial Sequence
  Description of Artificial Sequence: Synthetic peptide
  Seed: VYHRRGSRSYVPLAHSSSAF (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAF

SEQ ID NO: 341660 - protein, 20 aa, Artificial Sequence
  Description of Artificial Sequence: Synthetic peptide
  Seed: VYHRRGSRSYVPLAHSSSAF (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAF

SEQ ID NO: 341661 - protein, 21 aa, Artificial Sequence
  Description of Artificial Sequence: Synthetic peptide
  Seed: VYHRRGSRSYVPLAHSSSAFT (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSSAFT

SEQ ID NO: 341662 - protein, 21 aa, Artificial Sequence
  Description of Artificial Sequence: Synthetic peptide
  Seed: VYHRRGSRSYVPLAHSSSAFT (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAFT

SEQ ID NO: 341663 - protein, 21 aa, Artificial Sequence
  Description of Artificial Sequence: Synthetic peptide
  Seed: VYHRRGSRSYVPLAHSSSAFT (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAFT

SEQ ID NO: 341664 - protein, 21 aa, Artificial Sequence
  Description of Artificial Sequence: Synthetic peptide
  Seed: VYHRRGSRSYVPLAHSSSAFT (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAFT

SEQ ID NO: 341665 - protein, 22 aa, Artificial Sequence
  Description of Artificial Sequence: Synthetic peptide
  Seed: VYHRRGSRSYVPLAHSSSAFTI (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSSAFTI

SEQ ID NO: 341666 - protein, 22 aa, Artificial Sequence
  Description of Artificial Sequence: Synthetic peptide
  Seed: VYHRRGSRSYVPLAHSSSAFTI (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAFTI

SEQ ID NO: 341667 - protein, 22 aa, Artificial Sequence
  Description of Artificial Sequence: Synthetic peptide
  Seed: VYHRRGSRSYVPLAHSSSAFTI (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAFTI

SEQ ID NO: 341668 - protein, 22 aa, Artificial Sequence
  Description of Artificial Sequence: Synthetic peptide
  Seed: VYHRRGSRSYVPLAHSSSAFTI (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAFTI

SEQ ID NO: 341669 - protein, 22 aa, Artificial Sequence
  Description of Artificial Sequence: Synthetic peptide
  Seed: VYHRRGSRSYVPLAHSSSAFTI (PMEL_HUMAN)
  Core: LAHSSSAFT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPXAHXSXAFXI

SEQ ID NO: 341670 - protein, 23 aa, Artificial Sequence
  Description of Artificial Sequence: Synthetic peptide
  Seed: VYHRRGSRSYVPLAHSSSAFTIT (PMEL_HUMAN)
  Core: GSRSYVPLA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRXSRXYXPLXHSSSAFTIT

SEQ ID NO: 341671 - protein, 23 aa, Artificial Sequence
  Description of Artificial Sequence: Synthetic peptide
  Seed: VYHRRGSRSYVPLAHSSSAFTIT (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAFTIT

SEQ ID NO: 341672 - protein, 23 aa, Artificial Sequence
  Description of Artificial Sequence: Synthetic peptide
  Seed: VYHRRGSRSYVPLAHSSSAFTIT (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAFTIT

SEQ ID NO: 341673 - protein, 23 aa, Artificial Sequence
  Description of Artificial Sequence: Synthetic peptide
  Seed: VYHRRGSRSYVPLAHSSSAFTIT (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAFTIT

SEQ ID NO: 341674 - protein, 23 aa, Artificial Sequence
  Description of Artificial Sequence: Synthetic peptide
  Seed: VYHRRGSRSYVPLAHSSSAFTIT (PMEL_HUMAN)
  Core: LAHSSSAFT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPXAHXSXAFXIT

SEQ ID NO: 341675 - protein, 23 aa, Artificial Sequence
  Description of Artificial Sequence: Synthetic peptide
  Seed: VYHRRGSRSYVPLAHSSSAFTIT (PMEL_HUMAN)
  Core: AHSSSAFTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPLXHSXSXFTXT

SEQ ID NO: 341676 - protein, 24 aa, Artificial Sequence
  Description of Artificial Sequence: Synthetic peptide
  Seed: VYHRRGSRSYVPLAHSSSAFTITD (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAFTITD

SEQ ID NO: 341677 - protein, 24 aa, Artificial Sequence
  Description of Artificial Sequence: Synthetic peptide
  Seed: VYHRRGSRSYVPLAHSSSAFTITD (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAFTITD

SEQ ID NO: 341678 - protein, 24 aa, Artificial Sequence
  Description of Artificial Sequence: Synthetic peptide
  Seed: VYHRRGSRSYVPLAHSSSAFTITD (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAFTITD

SEQ ID NO: 341679 - protein, 24 aa, Artificial Sequence
  Description of Artificial Sequence: Synthetic peptide
  Seed: VYHRRGSRSYVPLAHSSSAFTITD (PMEL_HUMAN)
  Core: LAHSSSAFT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPXAHXSXAFXITD

SEQ ID NO: 341680 - protein, 24 aa, Artificial Sequence
  Description of Artificial Sequence: Synthetic peptide
  Seed: VYHRRGSRSYVPLAHSSSAFTITD (PMEL_HUMAN)
  Core: AHSSSAFTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPLXHSXSXFTXTD

SEQ ID NO: 341681 - protein, 25 aa, Artificial Sequence
  Description of Artificial Sequence: Synthetic peptide
  Seed: VYHRRGSRSYVPLAHSSSAFTITDQ (PMEL_HUMAN)
  Core: SRSYVPLAH
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGXRSXVXLAXSSSAFTITDQ

SEQ ID NO: 341682 - protein, 25 aa, Artificial Sequence
  Description of Artificial Sequence: Synthetic peptide
  Seed: VYHRRGSRSYVPLAHSSSAFTITDQ (PMEL_HUMAN)
  Core: RSYVPLAHS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSXSYXPXAHXSSAFTITDQ

SEQ ID NO: 341683 - protein, 25 aa, Artificial Sequence
  Description of Artificial Sequence: Synthetic peptide
  Seed: VYHRRGSRSYVPLAHSSSAFTITDQ (PMEL_HUMAN)
  Core: YVPLAHSSS
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSXVPXAXSSXAFTITDQ

SEQ ID NO: 341684 - protein, 25 aa, Artificial Sequence
  Description of Artificial Sequence: Synthetic peptide
  Seed: VYHRRGSRSYVPLAHSSSAFTITDQ (PMEL_HUMAN)
  Core: LAHSSSAFT
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPXAHXSXAFXITDQ

SEQ ID NO: 341685 - protein, 25 aa, Artificial Sequence
  Description of Artificial Sequence: Synthetic peptide
  Seed: VYHRRGSRSYVPLAHSSSAFTITDQ (PMEL_HUMAN)
  Core: AHSSSAFTI
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
VYHRRGSRSYVPLXHSXSXFTXTDQ

SEQ ID NO: 341686 - protein, 14 aa, Artificial Sequence
  Description of Artificial Sequence: Synthetic peptide
  Seed: VYVWKTWGQYWQVL (PMEL_HUMAN)
  Core: YVWKTWGQY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVWXTXGQXWQVL

SEQ ID NO: 341687 - protein, 15 aa, Artificial Sequence
  Description of Artificial Sequence: Synthetic peptide
  Seed: VYVWKTWGQYWQVLG (PMEL_HUMAN)
  Core: YVWKTWGQY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVWXTXGQXWQVLG

SEQ ID NO: 341688 - protein, 15 aa, Artificial Sequence
  Description of Artificial Sequence: Synthetic peptide
  Seed: VYVWKTWGQYWQVLG (PMEL_HUMAN)
  Core: WKTWGQYWQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VYVXKTXGXYWXVLG

SEQ ID NO: 341689 - protein, 15 aa, Artificial Sequence
  Description of Artificial Sequence: Synthetic peptide
  Seed: VYVWKTWGQYWQVLG (PMEL_HUMAN)
  Core: KTWGQYWQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VYVWXTWXQXWQXLG

SEQ ID NO: 341690 - protein, 15 aa, Artificial Sequence
  Description of Artificial Sequence: Synthetic peptide
  Seed: VYVWKTWGQYWQVLG (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXG

SEQ ID NO: 341691 - protein, 16 aa, Artificial Sequence
  Description of Artificial Sequence: Synthetic peptide
  Seed: VYVWKTWGQYWQVLGG (PMEL_HUMAN)
  Core: YVWKTWGQY
  misc_feature (2)..(2): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
VXVWXTXGQXWQVLGG

SEQ ID NO: 341692 - protein, 16 aa, Artificial Sequence
  Description of Artificial Sequence: Synthetic peptide
  Seed: VYVWKTWGQYWQVLGG (PMEL_HUMAN)
  Core: WKTWGQYWQ
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
VYVXKTXGXYWXVLGG

SEQ ID NO: 341693 - protein, 16 aa, Artificial Sequence
  Description of Artificial Sequence: Synthetic peptide
  Seed: VYVWKTWGQYWQVLGG (PMEL_HUMAN)
  Core: KTWGQYWQV
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
VYVWXTWXQXWQXLGG

SEQ ID NO: 341694 - protein, 16 aa, Artificial Sequence
  Description of Artificial Sequence: Synthetic peptide
  Seed: VYVWKTWGQYWQVLGG (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGG

SEQ ID NO: 341695 - protein, 17 aa, Artificial Sequence
  Description of Artificial Sequence: Synthetic peptide
  Seed: VYVWKTWGQYWQVLGGP (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGP

SEQ ID NO: 341696 - protein, 17 aa, Artificial Sequence
  Description of Artificial Sequence: Synthetic peptide
  Seed: VYVWKTWGQYWQVLGGP (PMEL_HUMAN)
  Core: WGQYWQVLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTXGQXWXVLXGP

SEQ ID NO: 341697 - protein, 18 aa, Artificial Sequence
  Description of Artificial Sequence: Synthetic peptide
  Seed: VYVWKTWGQYWQVLGGPV (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPV

SEQ ID NO: 341698 - protein, 18 aa, Artificial Sequence
  Description of Artificial Sequence: Synthetic peptide
  Seed: VYVWKTWGQYWQVLGGPV (PMEL_HUMAN)
  Core: WGQYWQVLG
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTXGQXWXVLXGPV

SEQ ID NO: 341699 - protein, 18 aa, Artificial Sequence
  Description of Artificial Sequence: Synthetic peptide
  Seed: VYVWKTWGQYWQVLGGPV (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPX

SEQ ID NO: 341700 - protein, 19 aa, Artificial Sequence
  Description of Artificial Sequence: Synthetic peptide
  Seed: VYVWKTWGQYWQVLGGPVS (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVS

SEQ ID NO: 341701 - protein, 19 aa, Artificial Sequence
  Description of Artificial Sequence: Synthetic peptide
  Seed: VYVWKTWGQYWQVLGGPVS (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVS

SEQ ID NO: 341702 - protein, 19 aa, Artificial Sequence
  Description of Artificial Sequence: Synthetic peptide
  Seed: VYVWKTWGQYWQVLGGPVS (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXS

SEQ ID NO: 341703 - protein, 20 aa, Artificial Sequence
  Description of Artificial Sequence: Synthetic peptide
  Seed: VYVWKTWGQYWQVLGGPVSG (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSG

SEQ ID NO: 341704 - protein, 20 aa, Artificial Sequence
  Description of Artificial Sequence: Synthetic peptide
  Seed: VYVWKTWGQYWQVLGGPVSG (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSG

SEQ ID NO: 341705 - protein, 20 aa, Artificial Sequence
  Description of Artificial Sequence: Synthetic peptide
  Seed: VYVWKTWGQYWQVLGGPVSG (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSG

SEQ ID NO: 341706 - protein, 20 aa, Artificial Sequence
  Description of Artificial Sequence: Synthetic peptide
  Seed: VYVWKTWGQYWQVLGGPVSG (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXG

SEQ ID NO: 341707 - protein, 21 aa, Artificial Sequence
  Description of Artificial Sequence: Synthetic peptide
  Seed: VYVWKTWGQYWQVLGGPVSGL (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSGL

SEQ ID NO: 341708 - protein, 21 aa, Artificial Sequence
  Description of Artificial Sequence: Synthetic peptide
  Seed: VYVWKTWGQYWQVLGGPVSGL (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSGL

SEQ ID NO: 341709 - protein, 21 aa, Artificial Sequence
  Description of Artificial Sequence: Synthetic peptide
  Seed: VYVWKTWGQYWQVLGGPVSGL (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSGL

SEQ ID NO: 341710 - protein, 21 aa, Artificial Sequence
  Description of Artificial Sequence: Synthetic peptide
  Seed: VYVWKTWGQYWQVLGGPVSGL (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXGL

SEQ ID NO: 341711 - protein, 22 aa, Artificial Sequence
  Description of Artificial Sequence: Synthetic peptide
  Seed: VYVWKTWGQYWQVLGGPVSGLS (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSGLS

SEQ ID NO: 341712 - protein, 22 aa, Artificial Sequence
  Description of Artificial Sequence: Synthetic peptide
  Seed: VYVWKTWGQYWQVLGGPVSGLS (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSGLS

SEQ ID NO: 341713 - protein, 22 aa, Artificial Sequence
  Description of Artificial Sequence: Synthetic peptide
  Seed: VYVWKTWGQYWQVLGGPVSGLS (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSGLS

SEQ ID NO: 341714 - protein, 22 aa, Artificial Sequence
  Description of Artificial Sequence: Synthetic peptide
  Seed: VYVWKTWGQYWQVLGGPVSGLS (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXGLS

SEQ ID NO: 341715 - protein, 22 aa, Artificial Sequence
  Description of Artificial Sequence: Synthetic peptide
  Seed: VYVWKTWGQYWQVLGGPVSGLS (PMEL_HUMAN)
  Core: VLGGPVSGL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYWQXLGXPXSGXS

SEQ ID NO: 341716 - protein, 23 aa, Artificial Sequence
  Description of Artificial Sequence: Synthetic peptide
  Seed: VYVWKTWGQYWQVLGGPVSGLSI (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSGLSI

SEQ ID NO: 341717 - protein, 23 aa, Artificial Sequence
  Description of Artificial Sequence: Synthetic peptide
  Seed: VYVWKTWGQYWQVLGGPVSGLSI (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSGLSI

SEQ ID NO: 341718 - protein, 23 aa, Artificial Sequence
  Description of Artificial Sequence: Synthetic peptide
  Seed: VYVWKTWGQYWQVLGGPVSGLSI (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSGLSI

SEQ ID NO: 341719 - protein, 23 aa, Artificial Sequence
  Description of Artificial Sequence: Synthetic peptide
  Seed: VYVWKTWGQYWQVLGGPVSGLSI (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXGLSI

SEQ ID NO: 341720 - protein, 23 aa, Artificial Sequence
  Description of Artificial Sequence: Synthetic peptide
  Seed: VYVWKTWGQYWQVLGGPVSGLSI (PMEL_HUMAN)
  Core: VLGGPVSGL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYWQXLGXPXSGXSI

SEQ ID NO: 341721 - protein, 24 aa, Artificial Sequence
  Description of Artificial Sequence: Synthetic peptide
  Seed: VYVWKTWGQYWQVLGGPVSGLSIG (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSGLSIG

SEQ ID NO: 341722 - protein, 24 aa, Artificial Sequence
  Description of Artificial Sequence: Synthetic peptide
  Seed: VYVWKTWGQYWQVLGGPVSGLSIG (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSGLSIG

SEQ ID NO: 341723 - protein, 24 aa, Artificial Sequence
  Description of Artificial Sequence: Synthetic peptide
  Seed: VYVWKTWGQYWQVLGGPVSGLSIG (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSGLSIG

SEQ ID NO: 341724 - protein, 24 aa, Artificial Sequence
  Description of Artificial Sequence: Synthetic peptide
  Seed: VYVWKTWGQYWQVLGGPVSGLSIG (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXGLSIG

SEQ ID NO: 341725 - protein, 24 aa, Artificial Sequence
  Description of Artificial Sequence: Synthetic peptide
  Seed: VYVWKTWGQYWQVLGGPVSGLSIG (PMEL_HUMAN)
  Core: VLGGPVSGL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYWQXLGXPXSGXSIG

SEQ ID NO: 341726 - protein, 25 aa, Artificial Sequence
  Description of Artificial Sequence: Synthetic peptide
  Seed: VYVWKTWGQYWQVLGGPVSGLSIGT (PMEL_HUMAN)
  Core: TWGQYWQVL
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKXWGXYXQVXGGPVSGLSIGT

SEQ ID NO: 341727 - protein, 25 aa, Artificial Sequence
  Description of Artificial Sequence: Synthetic peptide
  Seed: VYVWKTWGQYWQVLGGPVSGLSIGT (PMEL_HUMAN)
  Core: GQYWQVLGG
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWXQYXQXLGXPVSGLSIGT

SEQ ID NO: 341728 - protein, 25 aa, Artificial Sequence
  Description of Artificial Sequence: Synthetic peptide
  Seed: VYVWKTWGQYWQVLGGPVSGLSIGT (PMEL_HUMAN)
  Core: YWQVLGGPV
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQXWQXLXGPXSGLSIGT

SEQ ID NO: 341729 - protein, 25 aa, Artificial Sequence
  Description of Artificial Sequence: Synthetic peptide
  Seed: VYVWKTWGQYWQVLGGPVSGLSIGT (PMEL_HUMAN)
  Core: WQVLGGPVS
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYXQVXGXPVXGLSIGT

SEQ ID NO: 341730 - protein, 25 aa, Artificial Sequence
  Description of Artificial Sequence: Synthetic peptide
  Seed: VYVWKTWGQYWQVLGGPVSGLSIGT (PMEL_HUMAN)
  Core: VLGGPVSGL
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
VYVWKTWGQYWQXLGXPXSGXSIGT

SEQ ID NO: 341731 - protein, 14 aa, Artificial Sequence
  Description of Artificial Sequence: Synthetic peptide
  Seed: WDFGDSSGTLISRA (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRX

SEQ ID NO: 341732 - protein, 15 aa, Artificial Sequence
  Description of Artificial Sequence: Synthetic peptide
  Seed: WDFGDSSGTLISRAL (PMEL_HUMAN)
  Core: FGDSSGTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WDXGDXSXTLXSRAL

SEQ ID NO: 341733 - protein, 15 aa, Artificial Sequence
  Description of Artificial Sequence: Synthetic peptide
  Seed: WDFGDSSGTLISRAL (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXL

SEQ ID NO: 341734 - protein, 16 aa, Artificial Sequence
  Description of Artificial Sequence: Synthetic peptide
  Seed: WDFGDSSGTLISRALV (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLV

SEQ ID NO: 341735 - protein, 17 aa, Artificial Sequence
  Description of Artificial Sequence: Synthetic peptide
  Seed: WDFGDSSGTLISRALVV (PMEL_HUMAN)
  Core: FGDSSGTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WDXGDXSXTLXSRALVV

SEQ ID NO: 341736 - protein, 17 aa, Artificial Sequence
  Description of Artificial Sequence: Synthetic peptide
  Seed: WDFGDSSGTLISRALVV (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVV

SEQ ID NO: 341737 - protein, 17 aa, Artificial Sequence
  Description of Artificial Sequence: Synthetic peptide
  Seed: WDFGDSSGTLISRALVV (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXV

SEQ ID NO: 341738 - protein, 17 aa, Artificial Sequence
  Description of Artificial Sequence: Synthetic peptide
  Seed: WDFGDSSGTLISRALVV (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVX

SEQ ID NO: 341739 - protein, 18 aa, Artificial Sequence
  Description of Artificial Sequence: Synthetic peptide
  Seed: WDFGDSSGTLISRALVVT (PMEL_HUMAN)
  Core: FGDSSGTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WDXGDXSXTLXSRALVVT

SEQ ID NO: 341740 - protein, 18 aa, Artificial Sequence
  Description of Artificial Sequence: Synthetic peptide
  Seed: WDFGDSSGTLISRALVVT (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVT

SEQ ID NO: 341741 - protein, 19 aa, Artificial Sequence
  Description of Artificial Sequence: Synthetic peptide
  Seed: WDFGDSSGTLISRALVVTH (PMEL_HUMAN)
  Core: FGDSSGTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WDXGDXSXTLXSRALVVTH

SEQ ID NO: 341742 - protein, 19 aa, Artificial Sequence
  Description of Artificial Sequence: Synthetic peptide
  Seed: WDFGDSSGTLISRALVVTH (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTH

SEQ ID NO: 341743 - protein, 19 aa, Artificial Sequence
  Description of Artificial Sequence: Synthetic peptide
  Seed: WDFGDSSGTLISRALVVTH (PMEL_HUMAN)
  Core: SGTLISRAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSXGTXIXRAXVVTH

SEQ ID NO: 341744 - protein, 19 aa, Artificial Sequence
  Description of Artificial Sequence: Synthetic peptide
  Seed: WDFGDSSGTLISRALVVTH (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXVTH

SEQ ID NO: 341745 - protein, 19 aa, Artificial Sequence
  Description of Artificial Sequence: Synthetic peptide
  Seed: WDFGDSSGTLISRALVVTH (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTH

SEQ ID NO: 341746 - protein, 19 aa, Artificial Sequence
  Description of Artificial Sequence: Synthetic peptide
  Seed: WDFGDSSGTLISRALVVTH (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXH

SEQ ID NO: 341747 - protein, 20 aa, Artificial Sequence
  Description of Artificial Sequence: Synthetic peptide
  Seed: WDFGDSSGTLISRALVVTHT (PMEL_HUMAN)
  Core: FGDSSGTLI
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WDXGDXSXTLXSRALVVTHT

SEQ ID NO: 341748 - protein, 20 aa, Artificial Sequence
  Description of Artificial Sequence: Synthetic peptide
  Seed: WDFGDSSGTLISRALVVTHT (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHT

SEQ ID NO: 341749 - protein, 20 aa, Artificial Sequence
  Description of Artificial Sequence: Synthetic peptide
  Seed: WDFGDSSGTLISRALVVTHT (PMEL_HUMAN)
  Core: SGTLISRAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSXGTXIXRAXVVTHT

SEQ ID NO: 341750 - protein, 20 aa, Artificial Sequence
  Description of Artificial Sequence: Synthetic peptide
  Seed: WDFGDSSGTLISRALVVTHT (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXVTHT

SEQ ID NO: 341751 - protein, 20 aa, Artificial Sequence
  Description of Artificial Sequence: Synthetic peptide
  Seed: WDFGDSSGTLISRALVVTHT (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHT

SEQ ID NO: 341752 - protein, 20 aa, Artificial Sequence
  Description of Artificial Sequence: Synthetic peptide
  Seed: WDFGDSSGTLISRALVVTHT (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXHT

SEQ ID NO: 341753 - protein, 20 aa, Artificial Sequence
  Description of Artificial Sequence: Synthetic peptide
  Seed: WDFGDSSGTLISRALVVTHT (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXT

SEQ ID NO: 341754 - protein, 21 aa, Artificial Sequence
  Description of Artificial Sequence: Synthetic peptide
  Seed: WDFGDSSGTLISRALVVTHTY (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHTY

SEQ ID NO: 341755 - protein, 21 aa, Artificial Sequence
  Description of Artificial Sequence: Synthetic peptide
  Seed: WDFGDSSGTLISRALVVTHTY (PMEL_HUMAN)
  Core: SGTLISRAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSXGTXIXRAXVVTHTY

SEQ ID NO: 341756 - protein, 21 aa, Artificial Sequence
  Description of Artificial Sequence: Synthetic peptide
  Seed: WDFGDSSGTLISRALVVTHTY (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXVTHTY

SEQ ID NO: 341757 - protein, 21 aa, Artificial Sequence
  Description of Artificial Sequence: Synthetic peptide
  Seed: WDFGDSSGTLISRALVVTHTY (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHTY

SEQ ID NO: 341758 - protein, 21 aa, Artificial Sequence
  Description of Artificial Sequence: Synthetic peptide
  Seed: WDFGDSSGTLISRALVVTHTY (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXHTY

SEQ ID NO: 341759 - protein, 21 aa, Artificial Sequence
  Description of Artificial Sequence: Synthetic peptide
  Seed: WDFGDSSGTLISRALVVTHTY (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXTY

SEQ ID NO: 341760 - protein, 22 aa, Artificial Sequence
  Description of Artificial Sequence: Synthetic peptide
  Seed: WDFGDSSGTLISRALVVTHTYL (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHTYL

SEQ ID NO: 341761 - protein, 22 aa, Artificial Sequence
  Description of Artificial Sequence: Synthetic peptide
  Seed: WDFGDSSGTLISRALVVTHTYL (PMEL_HUMAN)
  Core: SGTLISRAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSXGTXIXRAXVVTHTYL

SEQ ID NO: 341762 - protein, 22 aa, Artificial Sequence
  Description of Artificial Sequence: Synthetic peptide
  Seed: WDFGDSSGTLISRALVVTHTYL (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXVTHTYL

SEQ ID NO: 341763 - protein, 22 aa, Artificial Sequence
  Description of Artificial Sequence: Synthetic peptide
  Seed: WDFGDSSGTLISRALVVTHTYL (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHTYL

SEQ ID NO: 341764 - protein, 22 aa, Artificial Sequence
  Description of Artificial Sequence: Synthetic peptide
  Seed: WDFGDSSGTLISRALVVTHTYL (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXHTYL

SEQ ID NO: 341765 - protein, 22 aa, Artificial Sequence
  Description of Artificial Sequence: Synthetic peptide
  Seed: WDFGDSSGTLISRALVVTHTYL (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXTYL

SEQ ID NO: 341766 - protein, 22 aa, Artificial Sequence
  Description of Artificial Sequence: Synthetic peptide
  Seed: WDFGDSSGTLISRALVVTHTYL (PMEL_HUMAN)
  Core: SRALVVTHT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLIXRAXVXTHXYL

SEQ ID NO: 341767 - protein, 23 aa, Artificial Sequence
  Description of Artificial Sequence: Synthetic peptide
  Seed: WDFGDSSGTLISRALVVTHTYLE (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHTYLE

SEQ ID NO: 341768 - protein, 23 aa, Artificial Sequence
  Description of Artificial Sequence: Synthetic peptide
  Seed: WDFGDSSGTLISRALVVTHTYLE (PMEL_HUMAN)
  Core: SGTLISRAL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSXGTXIXRAXVVTHTYLE

SEQ ID NO: 341769 - protein, 23 aa, Artificial Sequence
  Description of Artificial Sequence: Synthetic peptide
  Seed: WDFGDSSGTLISRALVVTHTYLE (PMEL_HUMAN)
  Core: GTLISRALV
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSXTLXSXALXVTHTYLE

SEQ ID NO: 341770 - protein, 23 aa, Artificial Sequence
  Description of Artificial Sequence: Synthetic peptide
  Seed: WDFGDSSGTLISRALVVTHTYLE (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHTYLE

SEQ ID NO: 341771 - protein, 23 aa, Artificial Sequence
  Description of Artificial Sequence: Synthetic peptide
  Seed: WDFGDSSGTLISRALVVTHTYLE (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXHTYLE

SEQ ID NO: 341772 - protein, 23 aa, Artificial Sequence
  Description of Artificial Sequence: Synthetic peptide
  Seed: WDFGDSSGTLISRALVVTHTYLE (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXTYLE

SEQ ID NO: 341773 - protein, 23 aa, Artificial Sequence
  Description of Artificial Sequence: Synthetic peptide
  Seed: WDFGDSSGTLISRALVVTHTYLE (PMEL_HUMAN)
  Core: SRALVVTHT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLIXRAXVXTHXYLE

SEQ ID NO: 341774 - protein, 23 aa, Artificial Sequence
  Description of Artificial Sequence: Synthetic peptide
  Seed: WDFGDSSGTLISRALVVTHTYLE (PMEL_HUMAN)
  Core: RALVVTHTY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISXALXVXHTXLE

SEQ ID NO: 341775 - protein, 23 aa, Artificial Sequence
  Description of Artificial Sequence: Synthetic peptide
  Seed: WDFGDSSGTLISRALVVTHTYLE (PMEL_HUMAN)
  Core: LVVTHTYLE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISRAXVVXHXYLX

SEQ ID NO: 341776 - protein, 24 aa, Artificial Sequence
  Description of Artificial Sequence: Synthetic peptide
  Seed: WDFGDSSGTLISRALVVTHTYLEP (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHTYLEP

SEQ ID NO: 341777 - protein, 24 aa, Artificial Sequence
  Description of Artificial Sequence: Synthetic peptide
  Seed: WDFGDSSGTLISRALVVTHTYLEP (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHTYLEP

SEQ ID NO: 341778 - protein, 24 aa, Artificial Sequence
  Description of Artificial Sequence: Synthetic peptide
  Seed: WDFGDSSGTLISRALVVTHTYLEP (PMEL_HUMAN)
  Core: LISRALVVT
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTXISXAXVVXHTYLEP

SEQ ID NO: 341779 - protein, 24 aa, Artificial Sequence
  Description of Artificial Sequence: Synthetic peptide
  Seed: WDFGDSSGTLISRALVVTHTYLEP (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXTYLEP

SEQ ID NO: 341780 - protein, 24 aa, Artificial Sequence
  Description of Artificial Sequence: Synthetic peptide
  Seed: WDFGDSSGTLISRALVVTHTYLEP (PMEL_HUMAN)
  Core: SRALVVTHT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLIXRAXVXTHXYLEP

SEQ ID NO: 341781 - protein, 24 aa, Artificial Sequence
  Description of Artificial Sequence: Synthetic peptide
  Seed: WDFGDSSGTLISRALVVTHTYLEP (PMEL_HUMAN)
  Core: RALVVTHTY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISXALXVXHTXLEP

SEQ ID NO: 341782 - protein, 24 aa, Artificial Sequence
  Description of Artificial Sequence: Synthetic peptide
  Seed: WDFGDSSGTLISRALVVTHTYLEP (PMEL_HUMAN)
  Core: LVVTHTYLE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISRAXVVXHXYLXP

SEQ ID NO: 341783 - protein, 25 aa, Artificial Sequence
  Description of Artificial Sequence: Synthetic peptide
  Seed: WDFGDSSGTLISRALVVTHTYLEPG (PMEL_HUMAN)
  Core: SSGTLISRA
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDXSGXLXSRXLVVTHTYLEPG

SEQ ID NO: 341784 - protein, 25 aa, Artificial Sequence
  Description of Artificial Sequence: Synthetic peptide
  Seed: WDFGDSSGTLISRALVVTHTYLEPG (PMEL_HUMAN)
  Core: TLISRALVV
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGXLIXRXLVXTHTYLEPG

SEQ ID NO: 341785 - protein, 25 aa, Artificial Sequence
  Description of Artificial Sequence: Synthetic peptide
  Seed: WDFGDSSGTLISRALVVTHTYLEPG (PMEL_HUMAN)
  Core: ISRALVVTH
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLXSRXLXVTXTYLEPG

SEQ ID NO: 341786 - protein, 25 aa, Artificial Sequence
  Description of Artificial Sequence: Synthetic peptide
  Seed: WDFGDSSGTLISRALVVTHTYLEPG (PMEL_HUMAN)
  Core: SRALVVTHT
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLIXRAXVXTHXYLEPG

SEQ ID NO: 341787 - protein, 25 aa, Artificial Sequence
  Description of Artificial Sequence: Synthetic peptide
  Seed: WDFGDSSGTLISRALVVTHTYLEPG (PMEL_HUMAN)
  Core: RALVVTHTY
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISXALXVXHTXLEPG

SEQ ID NO: 341788 - protein, 25 aa, Artificial Sequence
  Description of Artificial Sequence: Synthetic peptide
  Seed: WDFGDSSGTLISRALVVTHTYLEPG (PMEL_HUMAN)
  Core: LVVTHTYLE
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISRAXVVXHXYLXPG

SEQ ID NO: 341789 - protein, 25 aa, Artificial Sequence
  Description of Artificial Sequence: Synthetic peptide
  Seed: WDFGDSSGTLISRALVVTHTYLEPG (PMEL_HUMAN)
  Core: VVTHTYLEP
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (21)..(21): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (24)..(24): Xaa can be Ala, Cys, Asp, Glu, Phe, Gly, His, Ile, Lys, Leu, Met, Asn, Pro, Gln, Arg, Ser, Thr, Val, Trp, or Tyr
WDFGDSSGTLISRALXVTXTXLEXG

SEQ ID NO: 341790 - protein, 13 aa, Artificial Sequence
  Description of Artificial Sequence: Synthetic peptide
  Seed: WGQYWQVLGGPVS (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXS

SEQ ID NO: 341791 - protein, 13 aa, Artificial Sequence
  Description of Artificial Sequence: Synthetic peptide
  Seed: WGQYWQVLGGPVS (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVX

SEQ ID NO: 341792 - protein, 14 aa, Artificial Sequence
  Description of Artificial Sequence: Synthetic peptide
  Seed: WGQYWQVLGGPVSG (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSG

SEQ ID NO: 341793 - protein, 14 aa, Artificial Sequence
  Description of Artificial Sequence: Synthetic peptide
  Seed: WGQYWQVLGGPVSG (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXG

SEQ ID NO: 341794 - protein, 15 aa, Artificial Sequence
  Description of Artificial Sequence: Synthetic peptide
  Seed: WGQYWQVLGGPVSGL (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGL

SEQ ID NO: 341795 - protein, 15 aa, Artificial Sequence
  Description of Artificial Sequence: Synthetic peptide
  Seed: WGQYWQVLGGPVSGL (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGL

SEQ ID NO: 341796 - protein, 16 aa, Artificial Sequence
  Description of Artificial Sequence: Synthetic peptide
  Seed: WGQYWQVLGGPVSGLS (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLS

SEQ ID NO: 341797 - protein, 16 aa, Artificial Sequence
  Description of Artificial Sequence: Synthetic peptide
  Seed: WGQYWQVLGGPVSGLS (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLS

SEQ ID NO: 341798 - protein, 16 aa, Artificial Sequence
  Description of Artificial Sequence: Synthetic peptide
  Seed: WGQYWQVLGGPVSGLS (PMEL_HUMAN)
  Core: VLGGPVSGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQXLGXPXSGXS

SEQ ID NO: 341799 - protein, 17 aa, Artificial Sequence
  Description of Artificial Sequence: Synthetic peptide
  Seed: WGQYWQVLGGPVSGLSI (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSI

SEQ ID NO: 341800 - protein, 17 aa, Artificial Sequence
  Description of Artificial Sequence: Synthetic peptide
  Seed: WGQYWQVLGGPVSGLSI (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSI

SEQ ID NO: 341801 - protein, 17 aa, Artificial Sequence
  Description of Artificial Sequence: Synthetic peptide
  Seed: WGQYWQVLGGPVSGLSI (PMEL_HUMAN)
  Core: VLGGPVSGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQXLGXPXSGXSI

SEQ ID NO: 341802 - protein, 18 aa, Artificial Sequence
  Description of Artificial Sequence: Synthetic peptide
  Seed: WGQYWQVLGGPVSGLSIG (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIG

SEQ ID NO: 341803 - protein, 18 aa, Artificial Sequence
  Description of Artificial Sequence: Synthetic peptide
  Seed: WGQYWQVLGGPVSGLSIG (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIG

SEQ ID NO: 341804 - protein, 18 aa, Artificial Sequence
  Description of Artificial Sequence: Synthetic peptide
  Seed: WGQYWQVLGGPVSGLSIG (PMEL_HUMAN)
  Core: VLGGPVSGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQXLGXPXSGXSIG

SEQ ID NO: 341805 - protein, 19 aa, Artificial Sequence
  Description of Artificial Sequence: Synthetic peptide
  Seed: WGQYWQVLGGPVSGLSIGT (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGT

SEQ ID NO: 341806 - protein, 19 aa, Artificial Sequence
  Description of Artificial Sequence: Synthetic peptide
  Seed: WGQYWQVLGGPVSGLSIGT (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGT

SEQ ID NO: 341807 - protein, 19 aa, Artificial Sequence
  Description of Artificial Sequence: Synthetic peptide
  Seed: WGQYWQVLGGPVSGLSIGT (PMEL_HUMAN)
  Core: VLGGPVSGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQXLGXPXSGXSIGT

SEQ ID NO: 341808 - protein, 20 aa, Artificial Sequence
  Description of Artificial Sequence: Synthetic peptide
  Seed: WGQYWQVLGGPVSGLSIGTG (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTG

SEQ ID NO: 341809 - protein, 20 aa, Artificial Sequence
  Description of Artificial Sequence: Synthetic peptide
  Seed: WGQYWQVLGGPVSGLSIGTG (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTG

SEQ ID NO: 341810 - protein, 20 aa, Artificial Sequence
  Description of Artificial Sequence: Synthetic peptide
  Seed: WGQYWQVLGGPVSGLSIGTG (PMEL_HUMAN)
  Core: VLGGPVSGL
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQXLGXPXSGXSIGTG

SEQ ID NO: 341811 - protein, 20 aa, Artificial Sequence
  Description of Artificial Sequence: Synthetic peptide
  Seed: WGQYWQVLGGPVSGLSIGTG (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXG

SEQ ID NO: 341812 - protein, 21 aa, Artificial Sequence
  Description of Artificial Sequence: Synthetic peptide
  Seed: WGQYWQVLGGPVSGLSIGTGR (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTGR

SEQ ID NO: 341813 - protein, 21 aa, Artificial Sequence
  Description of Artificial Sequence: Synthetic peptide
  Seed: WGQYWQVLGGPVSGLSIGTGR (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTGR

SEQ ID NO: 341814 - protein, 21 aa, Artificial Sequence
  Description of Artificial Sequence: Synthetic peptide
  Seed: WGQYWQVLGGPVSGLSIGTGR (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXGR

SEQ ID NO: 341815 - protein, 21 aa, Artificial Sequence
  Description of Artificial Sequence: Synthetic peptide
  Seed: WGQYWQVLGGPVSGLSIGTGR (PMEL_HUMAN)
  Core: VSGLSIGTG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGPXSGXSXGTXR

SEQ ID NO: 341816 - protein, 22 aa, Artificial Sequence
  Description of Artificial Sequence: Synthetic peptide
  Seed: WGQYWQVLGGPVSGLSIGTGRA (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTGRA

SEQ ID NO: 341817 - protein, 22 aa, Artificial Sequence
  Description of Artificial Sequence: Synthetic peptide
  Seed: WGQYWQVLGGPVSGLSIGTGRA (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTGRA

SEQ ID NO: 341818 - protein, 22 aa, Artificial Sequence
  Description of Artificial Sequence: Synthetic peptide
  Seed: WGQYWQVLGGPVSGLSIGTGRA (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXGRA

SEQ ID NO: 341819 - protein, 22 aa, Artificial Sequence
  Description of Artificial Sequence: Synthetic peptide
  Seed: WGQYWQVLGGPVSGLSIGTGRA (PMEL_HUMAN)
  Core: VSGLSIGTG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGPXSGXSXGTXRA

SEQ ID NO: 341820 - protein, 23 aa, Artificial Sequence
  Description of Artificial Sequence: Synthetic peptide
  Seed: WGQYWQVLGGPVSGLSIGTGRAM (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTGRAM

SEQ ID NO: 341821 - protein, 23 aa, Artificial Sequence
  Description of Artificial Sequence: Synthetic peptide
  Seed: WGQYWQVLGGPVSGLSIGTGRAM (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTGRAM

SEQ ID NO: 341822 - protein, 23 aa, Artificial Sequence
  Description of Artificial Sequence: Synthetic peptide
  Seed: WGQYWQVLGGPVSGLSIGTGRAM (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXGRAM

SEQ ID NO: 341823 - protein, 23 aa, Artificial Sequence
  Description of Artificial Sequence: Synthetic peptide
  Seed: WGQYWQVLGGPVSGLSIGTGRAM (PMEL_HUMAN)
  Core: VSGLSIGTG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGPXSGXSXGTXRAM

SEQ ID NO: 341824 - protein, 24 aa, Artificial Sequence
  Description of Artificial Sequence: Synthetic peptide
  Seed: WGQYWQVLGGPVSGLSIGTGRAML (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTGRAML

SEQ ID NO: 341825 - protein, 24 aa, Artificial Sequence
  Description of Artificial Sequence: Synthetic peptide
  Seed: WGQYWQVLGGPVSGLSIGTGRAML (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTGRAML

SEQ ID NO: 341826 - protein, 24 aa, Artificial Sequence
  Description of Artificial Sequence: Synthetic peptide
  Seed: WGQYWQVLGGPVSGLSIGTGRAML (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXGRAML

SEQ ID NO: 341827 - protein, 24 aa, Artificial Sequence
  Description of Artificial Sequence: Synthetic peptide
  Seed: WGQYWQVLGGPVSGLSIGTGRAML (PMEL_HUMAN)
  Core: VSGLSIGTG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGPXSGXSXGTXRAML

SEQ ID NO: 341828 - protein, 25 aa, Artificial Sequence
  Description of Artificial Sequence: Synthetic peptide
  Seed: WGQYWQVLGGPVSGLSIGTGRAMLG (PMEL_HUMAN)
  Core: YWQVLGGPV
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WGQXWQXLXGPXSGLSIGTGRAMLG

SEQ ID NO: 341829 - protein, 25 aa, Artificial Sequence
  Description of Artificial Sequence: Synthetic peptide
  Seed: WGQYWQVLGGPVSGLSIGTGRAMLG (PMEL_HUMAN)
  Core: WQVLGGPVS
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WGQYXQVXGXPVXGLSIGTGRAMLG

SEQ ID NO: 341830 - protein, 25 aa, Artificial Sequence
  Description of Artificial Sequence: Synthetic peptide
  Seed: WGQYWQVLGGPVSGLSIGTGRAMLG (PMEL_HUMAN)
  Core: PVSGLSIGT
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGXVSXLXIGXGRAMLG

SEQ ID NO: 341831 - protein, 25 aa, Artificial Sequence
  Description of Artificial Sequence: Synthetic peptide
  Seed: WGQYWQVLGGPVSGLSIGTGRAMLG (PMEL_HUMAN)
  Core: VSGLSIGTG
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
WGQYWQVLGGPXSGXSXGTXRAMLG

SEQ ID NO: 341832 - protein, 15 aa, Artificial Sequence
  Description of Artificial Sequence: Synthetic peptide
  Seed: WKTWGQYWQVLGGPV (PMEL_HUMAN)
  Core: TWGQYWQVL
  misc_feature (3)..(3): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (6)..(6): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
WKXWGXYXQVXGGPV

SEQ ID NO: 341833 - protein, 15 aa, Artificial Sequence
  Description of Artificial Sequence: Synthetic peptide
  Seed: WKTWGQYWQVLGGPV (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPV

SEQ ID NO: 341834 - protein, 15 aa, Artificial Sequence
  Description of Artificial Sequence: Synthetic peptide
  Seed: WKTWGQYWQVLGGPV (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPX

SEQ ID NO: 341835 - protein, 16 aa, Artificial Sequence
  Description of Artificial Sequence: Synthetic peptide
  Seed: WKTWGQYWQVLGGPVS (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVS

SEQ ID NO: 341836 - protein, 16 aa, Artificial Sequence
  Description of Artificial Sequence: Synthetic peptide
  Seed: WKTWGQYWQVLGGPVS (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXS

SEQ ID NO: 341837 - protein, 17 aa, Artificial Sequence
  Description of Artificial Sequence: Synthetic peptide
  Seed: WKTWGQYWQVLGGPVSG (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSG

SEQ ID NO: 341838 - protein, 17 aa, Artificial Sequence
  Description of Artificial Sequence: Synthetic peptide
  Seed: WKTWGQYWQVLGGPVSG (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSG

SEQ ID NO: 341839 - protein, 17 aa, Artificial Sequence
  Description of Artificial Sequence: Synthetic peptide
  Seed: WKTWGQYWQVLGGPVSG (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXG

SEQ ID NO: 341840 - protein, 18 aa, Artificial Sequence
  Description of Artificial Sequence: Synthetic peptide
  Seed: WKTWGQYWQVLGGPVSGL (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGL

SEQ ID NO: 341841 - protein, 18 aa, Artificial Sequence
  Description of Artificial Sequence: Synthetic peptide
  Seed: WKTWGQYWQVLGGPVSGL (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGL

SEQ ID NO: 341842 - protein, 19 aa, Artificial Sequence
  Description of Artificial Sequence: Synthetic peptide
  Seed: WKTWGQYWQVLGGPVSGLS (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLS

SEQ ID NO: 341843 - protein, 19 aa, Artificial Sequence
  Description of Artificial Sequence: Synthetic peptide
  Seed: WKTWGQYWQVLGGPVSGLS (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLS

SEQ ID NO: 341844 - protein, 19 aa, Artificial Sequence
  Description of Artificial Sequence: Synthetic peptide
  Seed: WKTWGQYWQVLGGPVSGLS (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLS

SEQ ID NO: 341845 - protein, 19 aa, Artificial Sequence
  Description of Artificial Sequence: Synthetic peptide
  Seed: WKTWGQYWQVLGGPVSGLS (PMEL_HUMAN)
  Core: VLGGPVSGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQXLGXPXSGXS

SEQ ID NO: 341846 - protein, 20 aa, Artificial Sequence
  Description of Artificial Sequence: Synthetic peptide
  Seed: WKTWGQYWQVLGGPVSGLSI (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSI

SEQ ID NO: 341847 - protein, 20 aa, Artificial Sequence
  Description of Artificial Sequence: Synthetic peptide
  Seed: WKTWGQYWQVLGGPVSGLSI (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSI

SEQ ID NO: 341848 - protein, 20 aa, Artificial Sequence
  Description of Artificial Sequence: Synthetic peptide
  Seed: WKTWGQYWQVLGGPVSGLSI (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSI

SEQ ID NO: 341849 - protein, 20 aa, Artificial Sequence
  Description of Artificial Sequence: Synthetic peptide
  Seed: WKTWGQYWQVLGGPVSGLSI (PMEL_HUMAN)
  Core: VLGGPVSGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQXLGXPXSGXSI

SEQ ID NO: 341850 - protein, 21 aa, Artificial Sequence
  Description of Artificial Sequence: Synthetic peptide
  Seed: WKTWGQYWQVLGGPVSGLSIG (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSIG

SEQ ID NO: 341851 - protein, 21 aa, Artificial Sequence
  Description of Artificial Sequence: Synthetic peptide
  Seed: WKTWGQYWQVLGGPVSGLSIG (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSIG

SEQ ID NO: 341852 - protein, 21 aa, Artificial Sequence
  Description of Artificial Sequence: Synthetic peptide
  Seed: WKTWGQYWQVLGGPVSGLSIG (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSIG

SEQ ID NO: 341853 - protein, 21 aa, Artificial Sequence
  Description of Artificial Sequence: Synthetic peptide
  Seed: WKTWGQYWQVLGGPVSGLSIG (PMEL_HUMAN)
  Core: VLGGPVSGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQXLGXPXSGXSIG

SEQ ID NO: 341854 - protein, 22 aa, Artificial Sequence
  Description of Artificial Sequence: Synthetic peptide
  Seed: WKTWGQYWQVLGGPVSGLSIGT (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSIGT

SEQ ID NO: 341855 - protein, 22 aa, Artificial Sequence
  Description of Artificial Sequence: Synthetic peptide
  Seed: WKTWGQYWQVLGGPVSGLSIGT (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSIGT

SEQ ID NO: 341856 - protein, 22 aa, Artificial Sequence
  Description of Artificial Sequence: Synthetic peptide
  Seed: WKTWGQYWQVLGGPVSGLSIGT (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSIGT

SEQ ID NO: 341857 - protein, 22 aa, Artificial Sequence
  Description of Artificial Sequence: Synthetic peptide
  Seed: WKTWGQYWQVLGGPVSGLSIGT (PMEL_HUMAN)
  Core: VLGGPVSGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQXLGXPXSGXSIGT

SEQ ID NO: 341858 - protein, 23 aa, Artificial Sequence
  Description of Artificial Sequence: Synthetic peptide
  Seed: WKTWGQYWQVLGGPVSGLSIGTG (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSIGTG

SEQ ID NO: 341859 - protein, 23 aa, Artificial Sequence
  Description of Artificial Sequence: Synthetic peptide
  Seed: WKTWGQYWQVLGGPVSGLSIGTG (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSIGTG

SEQ ID NO: 341860 - protein, 23 aa, Artificial Sequence
  Description of Artificial Sequence: Synthetic peptide
  Seed: WKTWGQYWQVLGGPVSGLSIGTG (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSIGTG

SEQ ID NO: 341861 - protein, 23 aa, Artificial Sequence
  Description of Artificial Sequence: Synthetic peptide
  Seed: WKTWGQYWQVLGGPVSGLSIGTG (PMEL_HUMAN)
  Core: VLGGPVSGL
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQXLGXPXSGXSIGTG

SEQ ID NO: 341862 - protein, 23 aa, Artificial Sequence
  Description of Artificial Sequence: Synthetic peptide
  Seed: WKTWGQYWQVLGGPVSGLSIGTG (PMEL_HUMAN)
  Core: PVSGLSIGT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQVLGGXVSXLXIGXG

SEQ ID NO: 341863 - protein, 24 aa, Artificial Sequence
  Description of Artificial Sequence: Synthetic peptide
  Seed: WKTWGQYWQVLGGPVSGLSIGTGR (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSIGTGR

SEQ ID NO: 341864 - protein, 24 aa, Artificial Sequence
  Description of Artificial Sequence: Synthetic peptide
  Seed: WKTWGQYWQVLGGPVSGLSIGTGR (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSIGTGR

SEQ ID NO: 341865 - protein, 24 aa, Artificial Sequence
  Description of Artificial Sequence: Synthetic peptide
  Seed: WKTWGQYWQVLGGPVSGLSIGTGR (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSIGTGR

SEQ ID NO: 341866 - protein, 24 aa, Artificial Sequence
  Description of Artificial Sequence: Synthetic peptide
  Seed: WKTWGQYWQVLGGPVSGLSIGTGR (PMEL_HUMAN)
  Core: PVSGLSIGT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQVLGGXVSXLXIGXGR

SEQ ID NO: 341867 - protein, 24 aa, Artificial Sequence
  Description of Artificial Sequence: Synthetic peptide
  Seed: WKTWGQYWQVLGGPVSGLSIGTGR (PMEL_HUMAN)
  Core: VSGLSIGTG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQVLGGPXSGXSXGTXR

SEQ ID NO: 341868 - protein, 25 aa, Artificial Sequence
  Description of Artificial Sequence: Synthetic peptide
  Seed: WKTWGQYWQVLGGPVSGLSIGTGRA (PMEL_HUMAN)
  Core: GQYWQVLGG
  misc_feature (5)..(5): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
WKTWXQYXQXLGXPVSGLSIGTGRA

SEQ ID NO: 341869 - protein, 25 aa, Artificial Sequence
  Description of Artificial Sequence: Synthetic peptide
  Seed: WKTWGQYWQVLGGPVSGLSIGTGRA (PMEL_HUMAN)
  Core: YWQVLGGPV
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (10)..(10): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQXWQXLXGPXSGLSIGTGRA

SEQ ID NO: 341870 - protein, 25 aa, Artificial Sequence
  Description of Artificial Sequence: Synthetic peptide
  Seed: WKTWGQYWQVLGGPVSGLSIGTGRA (PMEL_HUMAN)
  Core: WQVLGGPVS
  misc_feature (8)..(8): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (11)..(11): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (13)..(13): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (16)..(16): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYXQVXGXPVXGLSIGTGRA

SEQ ID NO: 341871 - protein, 25 aa, Artificial Sequence
  Description of Artificial Sequence: Synthetic peptide
  Seed: WKTWGQYWQVLGGPVSGLSIGTGRA (PMEL_HUMAN)
  Core: PVSGLSIGT
  misc_feature (14)..(14): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (17)..(17): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (19)..(19): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (22)..(22): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQVLGGXVSXLXIGXGRA

SEQ ID NO: 341872 - protein, 25 aa, Artificial Sequence
  Description of Artificial Sequence: Synthetic peptide
  Seed: WKTWGQYWQVLGGPVSGLSIGTGRA (PMEL_HUMAN)
  Core: VSGLSIGTG
  misc_feature (15)..(15): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (18)..(18): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (20)..(20): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (23)..(23): Xaa can be Ala, Cys, Asp, Glu, Phe, Gly, His, Ile, Lys, Leu, Met, Asn, Pro, Gln, Arg, Ser, Thr, Val, Trp, or Tyr
WKTWGQYWQVLGGPXSGXSXGTXRA

SEQ ID NO: 341873 - protein, 13 aa, Artificial Sequence
  Description of Artificial Sequence: Synthetic peptide
  Seed: WLGVSRQLRTKAW (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXW

SEQ ID NO: 341874 - protein, 14 aa, Artificial Sequence
  Description of Artificial Sequence: Synthetic peptide
  Seed: WLGVSRQLRTKAWN (PMEL_HUMAN)
  Core: VSRQLRTKA
  misc_feature (4)..(4): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (7)..(7): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (9)..(9): Xaa can be Ala, Cys, Asp, Glu, Phe, Gly, His, Ile, Lys, Leu, Met, Asn, Pro, Gln, Arg, Ser, Thr, Val, Trp, or Tyr
  misc_feature (12)..(12): Xaa can be Ala, Cys, Asp, Glu, Phe, Gly, His, Ile, Lys, Leu, Met, Asn, Pro, Gln, Arg, Ser, Thr, Val, Trp, or Tyr
WLGXSRXLXTKXWN
